(12) United States Patent
Rastelli et al.

(10) Patent No.: US 6,964,849 B2
(45) Date of Patent: Nov. 15, 2005

(54) PROTEINS AND NUCLEIC ACIDS ENCODING SAME

(75) Inventors: Luca Rastelli, Guilford, CT (US); John L. Herrmann, Guilford, CT (US); John R. MacDougall, Guilford, CT (US); Haihong Zhong, Guilford, CT (US)

(73) Assignee: Curagen Corporation, New Haven, CT (US)

( * ) Notice: Subject to any disclaimer, the term of this patent is extended or adjusted under 35 U.S.C. 154(b) by 546 days.

(21) Appl. No.: 10/099,322

(22) Filed: Mar. 15, 2002

(65) Prior Publication Data

US 2003/0215449 A1 Nov. 20, 2003

Related U.S. Application Data

(63) Continuation-in-part of application No. 10/044,564, filed on Jan. 11, 2002.
(60) Provisional application No. 60/261,014, filed on Jan. 11, 2001, provisional application No. 60/261,018, filed on Jan. 11, 2001, provisional application No. 60/318,410, filed on Sep. 10, 2001, provisional application No. 60/261,013, filed on Jan. 11, 2001, provisional application No. 60/261,029, filed on Jan. 11, 2001, provisional application No. 60/261,026, filed on Jan. 11, 2001, provisional application No. 60/313,170, filed on Aug. 17, 2001, and provisional application No. 60/278,152, filed on Mar. 23, 2001.

(51) Int. Cl.[7] .................... C12Q 1/68; C12N 15/63; A61K 31/711; C07H 21/04
(52) U.S. Cl. .................... 435/6; 435/252.3; 435/254.11; 435/320.1; 435/325; 514/44; 536/23.5
(58) Field of Search .................... 435/6, 252.3, 254.11, 435/320.1, 325; 514/44; 536/23.5

(56) References Cited

U.S. PATENT DOCUMENTS

| | | | |
|---|---|---|---|
| 3,773,919 A | 11/1973 | Boswell et al. ............... 424/19 |
| 4,485,045 A | 11/1984 | Regen ........................ 260/403 |
| 4,522,811 A | 6/1985 | Eppstein et al. ............... 514/2 |
| 4,544,545 A | 10/1985 | Ryan et al. .................... 424/1.1 |
| 4,676,980 A | 6/1987 | Segal et al. .................... 424/85 |
| 4,683,195 A | 7/1987 | Mullis et al. .................. 435/6 |
| 4,683,202 A | 7/1987 | Mullis ......................... 435/91 |
| 4,736,866 A | 4/1988 | Leder et al. .................... 800/1 |
| 4,816,567 A | 3/1989 | Cabilly et al. ............... 530/387 |
| 4,870,009 A | 9/1989 | Evans et al. ................... 435/70 |
| 4,873,191 A | 10/1989 | Wagner et al. ........... 435/172.3 |
| 4,873,316 A | 10/1989 | Meade et al. ................ 530/412 |
| 4,946,778 A | 8/1990 | Ladner et al. ............. 435/69.6 |
| 4,987,071 A | 1/1991 | Cech et al. .................... 435/91 |
| 5,013,556 A | 5/1991 | Woodle et al. .............. 424/450 |
| 5,116,742 A | 5/1992 | Cech et al. .................... 435/91 |
| 5,223,409 A | 6/1993 | Ladner et al. ............. 435/69.7 |
| 5,225,539 A | 7/1993 | Winter .................... 530/387.3 |
| 5,272,057 A | 12/1993 | Smulson et al. ............... 435/6 |
| 5,283,317 A | 2/1994 | Saifer et al. ................ 528/405 |
| 5,328,470 A | 7/1994 | Nabel et al. ................ 604/101 |
| 5,459,039 A | 10/1995 | Modrich et al. ............... 435/6 |
| 5,545,806 A | 8/1996 | Lonberg et al. ................ 800/2 |
| 5,545,807 A | 8/1996 | Surani et al. ................... 800/2 |
| 5,569,825 A | 10/1996 | Lonberg et al. ................ 800/2 |
| 5,625,126 A | 4/1997 | Lonberg et al. ................ 800/2 |
| 5,633,425 A | 5/1997 | Lonberg et al. ................ 800/2 |
| 5,661,016 A | 8/1997 | Lonberg et al. .......... 435/172.3 |
| 5,693,465 A | * 12/1997 | Manning et al. ............... 435/6 |
| 5,916,771 A | 6/1999 | Hori et al. ................. 435/69.6 |
| 5,939,598 A | 8/1999 | Kucherlapati et al. ........ 800/25 |

OTHER PUBLICATIONS

GenBank Accession No.: AAB00193 (Oct. 16, 2001).
GenBank Accession No.: AAB08543 (Sep. 20, 1996).
GenBank Accession No.: AAB08544 (Sep. 20, 1996).
GenBank Accession No.: AAB08547 (Sep. 20, 1996).
GenBank Accession No.: AAB12117 (Oct. 7, 1996).
GenBank Accession No.: AAB24422 (May 8, 1993).
GenBank Accession No.: AAB43987 (Feb. 7, 1997).
GenBank Accession No.: AAB48183 (Feb. 28, 1997).
GenBank Accession No.: AB54035 (Nov. 19, 2002).
GenBank Accession No.: AAB54345 (May 14, 1997).
GenBank Accession No.: AAB55957 (May 14, 1997).
GenBank Accession No.: AAB59591 (Nov. 13, 1995).
GenBank Accession No.: AAB63531 (Jul. 21, 1997).
GenBank Accession No.: AAB63535 (Feb. 27, 2002).
GenBank Accession No.: AAB73307 (Oct. 8, 1997).
GenBank Accession No.: AAB73308 (Oct. 8, 1997).
GenBank Accession No.: AAB76853 (Oct. 8, 1997).
GenBank Accession No.: AAB81822 (Oct. 26, 1997).
GenBank Accession No.: AAB90773 (Mar. 17, 2003).
GenBank Accession No.: AAB96388 (Jul. 13, 2000).
GenBank Accession No.: AAE05921 (Sep. 29, 1999).
GenBank Accession No.: AAE06704 (Sep. 29, 1999).
GenBank Accession No.: AAE06704 (Sep. 29, 1999).
GenBank Accession No.: AAG00220 (Aug. 16, 2000).
GenBank Accession No.: AAG10768 (Sep. 7, 2000).
GenBank Accession No.: AAG10769 (Sep. 7, 2000).
GenBank Accession No.: AAG10770 (Sep. 7, 2000).
GenBank Accession No.: AAM93539 (Jun. 30, 2003).
GenBank Accession No.: AAR26876 (Jan. 30, 2004).
GenBank Accession No.: AAR53992 (Dec. 18, 2003).
GenBank Accession No.: AAR91950 (Jan. 18, 2004).
GenBank Accession No.: AAR96044 (Jan. 21, 2004).

(Continued)

*Primary Examiner*—Robert A. Wax
(74) *Attorney, Agent, or Firm*—Ivor R. Elrifi; Mintz, Levin Cohn, Ferris, Glovsky and Popeo P.C.; Naomi S. Biswas

(57) ABSTRACT

Disclosed herein are nucleic acid sequences that encode novel polypeptides. Also disclosed are polypeptides encoded by these nucleic acid sequences, and antibodies, which immunospecifically-bind to the polypeptide, as well as derivatives, variants, mutants, or fragments of the aforementioned polypeptide, polynucleotide, or antibody. The invention further discloses therapeutic, diagnostic and research methods for diagnosis, treatment, and prevention of disorders involving any one of these novel human nucleic acids and proteins.

15 Claims, No Drawings

OTHER PUBLICATIONS

GenBank Accession No.: AAR96045 (Jan. 21, 2004).
GenBank Accession No.: AK005068 (Sep. 20, 2003).
GenBank Accession No.: AK021164 (Sep. 20, 2003).
GenBank Accession No.: AL033383 (Jun. 15, 2000).
GenBank Accession No.: BC002668 (Nov. 12, 2003).
GenBank Accession No.: BC012089 (Oct. 4, 2003).
GenBank Accession No.: L27124 (Sep. 30, 1994).
GenBank Accession No.: O43490 (Sep. 15, 2003).
GenBank Accession No.: P15541 (Mar. 15, 2004).
GenBank Accession No.: Q9W742 (Sep. 15, 2003).
GenBank Accession No.: S66253 (Mar. 13, 1997).
GenBank Accession No.: XM_008313 (May 8, 2002).
Albrecht, C., H. von Der Kammer, et al. (2000). "Muscarinic acetylcholine receptors induce the expression of the immediate early growth regulatory gene CYR61." J Biol Chem 275(37): 28929–36.
Brown, G. K. (2000). "Glucose transporters: structure, function and consequences of deficiency." J Inherit Metab Dis 23(3): 237–46.
Drobnik, W., H. Borsukova, et al. (2002). "Apo AI/ABCA1–dependent and HDL3–mediated lipid efflux from compositionally distinct cholesterol–based microdomains." Traffic 3(4): 268–78.
Hassan, R., J. L. Viner, et al. (2000). "Anti–tumor activity of K1–LysPE38QQR, an immunotoxin targeting mesothelin, a cell–surface antigen overexpressed in ovarian cancer and malignant mesothelioma." J Immunother 23(4): 473–9.
Hoover–Plow, J. and L. Yuen (2001). "Plasminogen binding is increased with adipocyte differentiation." Biochem Biophys Res Commun 284(2): 389–94.
Hospital, V., V. Chesneau, et al. (2000). "N–arginine dibasic convertase (nardilysin) isoforms are soluble dibasic–specific metalloendopeptidases that localize in the cytoplasm and at the cell surface." Biochem J 349 (Pt 2): 587–97.
Magee, J. A., T. Araki, et al. (2001), "Expression profiling reveals hepsin overexpression in prostate cancer." Cancer Res 61(15): 5692–6.
Moriwaki, J., E. Kajita, et al. (2000). "Isolation of Xenopus frizzled–10A and frizzled–10B genomic clones and their expression in adult tissues and embryos." Biochem Biophys Res Commun 278(2): 377–84.
Nishi, E., A. Prat, et al. (2001). "N–arginine dibasic convertase is a specific receptor for heparin–binding EGF–like growth factor that mediates cell migration." Embo J 20 (13): 3342–50.
Ohkuma, S., M. Katsura, et al. (2001). "Alterations in cerebral diazepam binding inhibitor expression in drug dependence: a possible biochemical alteration common to drug dependence." Life Sci 68(11): 1215–22.
Selvarajan, S., L. R. Lund, et al. (2001). "A plasma kallikrein–dependent plasminogen cascade required for adipocyte differentiation." Nat Cell Biol 3(3): 267–75.
Sonneveld, P. (2000). "Multidrug resistance in haemalological malignancies." J Intern Med 247(5): 521–34.
Takahashi, H., M. Oh–Ishi, et al. (2001). "Detection and identification of subcutaneous adipose tissue protein related to obesity in New Zealand obese mouse." Endocr J 48(2): 205–11.
Takeda, A. (2000). "Movement of zinc and its functional significance in the brain." Brain Res Brain Res Rev 34(3): 137–48.
Tang, X. and N. F. Shay (2001). "Zinc has an insulin–like effect on glucose transport mediated by phosphoinositol–3–kinase and Akt in 3T3–L1 fibroblasts and adipocytes." J Nutr 131(5): 1414 20.
Tani, K., F. Ogushi, et al. (2001). "Protease–induced leukocyte chemotaxis and activation: roles in host defense and inflammation." J Med Invest 48(3–4): 133–41.
Taupin, D., J. Pederson, et al. (2001), "Augmented intestinal trefoil factor (TFF3) and loss of pS2 (TFF1) expression precedes metaplastic differentiation of gastric epithelium." Lab Invest 81(3): 397–408.
Taylor, K. M. (2000). "LIV–1 breast cancer protein belongs to new family of histidine–rich membrane proteins with potential to control intracellular Zn2+ homeostasis." IUBMB Life 49(4): 249–53.
Wilkinson, D., published by The Scientist, Inc., Philadelphia PA, vol. 14, No. 8 (Apr. 17, 2000), pp. 25–28.
Van Raay, T. J., Y. K. Wang, et al. (2001). "frizzled 9 is expressed in neural precursor cells in the developing neural tube." Dev Genes Evol 211 (8–9): 453–7.
Vikolinsky R, Cairns N, Fountoulakis M, Lubec G.. et al. (2001). " Decreased brain levels of 2',3'–cyclic nucleotide–3'–phosphodiesterase in Down syndrome and Alzheimer's disease." Neurobiol Aging 22(4):547–53.
Wu, Q. (2001). "Gene targeting in hemostasis. Hepsin," Front Biosci 6: D192–200.
Yousef, G. M. and E. P. Diamandis (2001). "The new human tissue kallikrein gene family: structure, function, and association to disease." Endocr Rev 22(2): 184–204.
GenBank Accession No.: AAE07205 (Sep. 29, 1999).
GenBank Accession No.: AAE07206 (Sep. 29, 1999).
GenBank Accession No.: AAM51198 (Jan. 14, 2003).
GeneScape Accession No.: AAU74631 (Apr. 9, 2002).
SWALL (SPTR) Accession No.: Q13433 (Nov. 1, 1996).

* cited by examiner

_US 6,964,849 B2_

PROTEINS AND NUCLEIC ACIDS ENCODING SAME

RELATED APPLICATIONS

This application is a Continuation-in-Part application of U.S. Ser. No. 10/044,564, filed Jan. 11, 2002 and claims priority from U.S. Ser. No. 60/261,014, filed Jan. 11, 2001; U.S. Ser. No. 60/261,018, filed Jan. 11, 2001; U.S. Ser. No. 60/318,410 filed Sep. 10, 2001; U.S. Ser. No. 60/261,013 filed Jan. 11, 2001; U.S. Ser. No. 60/261,029, filed Jan. 11, 2001; U.S. Ser. No. 60/261,026, filed Jan. 11, 2001; U.S. Ser. No. 60/313,170 filed Aug. 17, 2001; and U.S. Ser. No. 60/278,152, filed Mar. 23, 2001, each of which is incorporated by reference in its entirety.

FIELD OF THE INVENTION

The invention generally relates to nucleic acids and polypeptides encoded thereby.

BACKGROUND OF THE INVENTION

The invention generally relates to nucleic acids and polypeptides encoded therefrom. More specifically, the invention relates to nucleic acids encoding cytoplasmic, nuclear, membrane bound, and secreted polypeptides, as well as vectors, host cells, antibodies, and recombinant methods for producing these nucleic acids and polypeptides.

SUMMARY OF THE INVENTION

The invention is based in part upon the discovery of nucleic acid sequences encoding polypeptides. The nucleic acids and polypeptides are referred to herein as SEC1, SEC2, SEC3, SEC4, SEC5, SEC6, SEC7, SEC8, SEC9, SEC10, SEC11, and SEC12 nucleic acids and polypeptides. These nucleic acids and polypeptides, as well as derivatives, homologs, analogs and fragments thereof, will hereinafter be collectively designated as "SECX" nucleic acid or polypeptide sequences.

In one aspect, the invention provides an isolated SECX nucleic acid molecule encoding a SECX polypeptide that includes a nucleic acid sequence that has identity to the nucleic acids disclosed in SEQ ID NOS:1, 3, 5, 7, 9, 11, 13, 15, 17, 19, 21, and 23. In some embodiments, the SECX nucleic acid molecule will hybridize under stringent conditions to a nucleic acid sequence complementary to a nucleic acid molecule that includes a protein-coding sequence of a SECX nucleic acid sequence. The invention also includes an isolated nucleic acid that encodes a SECX polypeptide, or a fragment, homolog, analog or derivative thereof. For example, the nucleic acid can encode a polypeptide at least 80% identical to a polypeptide comprising the amino acid sequences encoded by SEQ ID NOS:1, 3, 5, 7, 9, 11, 13, 15, 17, 19, 21, and 23. The nucleic acid can be, for example, a genomic DNA fragment or a cDNA molecule that includes the nucleic acid sequence of any of SEQ ID NOS:1, 3, 5, 7, 9, 11, 13, 15, 17, 19, 21, and 23.

Also included in the invention is an oligonucleotide, e.g., an oligonucleotide which includes at least 6 contiguous nucleotides of a SECX nucleic acid (e.g., SEQ ID NOS:1, 3, 5, 7, 9, 11, 13, 15, 17, 19, 21, and 23) or a complement of said oligonucleotide.

Also included in the invention are substantially purified SECX polypeptides (SEQ ID NOS: 2, 4, 6, 8, 10, 12, 14, 16, 18, 20, 22, and 24). In certain embodiments, the SECX polypeptides include an amino acid sequence that is substantially identical to the amino acid sequence of a human SECX polypeptide.

The invention is also based in part upon the discovery of nucleic acid sequences encoding novel polypeptides. The novel nucleic acids and polypeptides are referred to herein as NOVX, or NOV1, NOV2, NOV3, NOV4, NOV5, NOV6, NOV7, and NOV8 nucleic acids and polypeptides. These nucleic acids and polypeptides, as well as derivatives, homologs, analogs and fragments thereof, will hereinafter be collectively designated as "NOVX" nucleic acid or polypeptide sequences.

In one aspect, the invention provides an isolated NOVX nucleic acid molecule encoding a NOVX polypeptide that includes a nucleic acid sequence that has identity to the nucleic acids disclosed in SEQ ID NOS:25, 27, 29, 31, 33, 35, 37, 39 and 319. In some embodiments, the NOVX nucleic acid molecule will hybridize under stringent conditions to a nucleic acid sequence complementary to a nucleic acid molecule that includes a protein-coding sequence of a NOVX nucleic acid sequence. The invention also includes an isolated nucleic acid that encodes a NOVX polypeptide, or a fragment, homolog, analog or derivative thereof. For example, the nucleic acid can encode a polypeptide at least 80% identical to a polypeptide comprising the amino acid sequences of SEQ ID NOS:26, 28, 30, 32, 34, 36, 38, 40 and 320. The nucleic acid can be, for example, a genomic DNA fragment or a cDNA molecule that includes the nucleic acid sequence of any of SEQ ID NOS:25, 27, 29, 31, 33, 35, 37, 39 and 319.

Also included in the invention is an oligonucleotide, e.g., an oligonucleotide which includes at least 6 contiguous nucleotides of a NOVX nucleic acid (e.g., SEQ ID NOS:25, 27, 29, 31, 33, 35, 37, 39 and 319) or a complement of said oligonucleotide.

Also included in the invention are substantially purified NOVX polypeptides (SEQ ID NOS:26, 28, 30, 32, 34, 36, 38, 40 and 320). In certain embodiments, the NOVX polypeptides include an amino acid sequence that is substantially identical to the amino acid sequence of a human NOVX polypeptide.

The invention also features antibodies that immunoselectively bind to SECX and/or NOVX polypeptides, or fragments, homologs, analogs or derivatives thereof.

In another aspect, the invention includes pharmaceutical compositions that include therapeutically- or prophylactically-effective amounts of a therapeutic and a pharmaceutically-acceptable carrier. The therapeutic can be, e.g., a SECX and/or NOVX nucleic acid, a SECX and/or NOVX polypeptide, or an antibody specific for a SECX and/or NOVX polypeptide. In a further aspect, the invention includes, in one or more containers, a therapeutically- or prophylactically-effective amount of this pharmaceutical composition.

In a further aspect, the invention includes a method of producing a polypeptide by culturing a cell that includes a SECX and/or NOVX nucleic acid, under conditions allowing for expression of the SECX and/or NOVX polypeptide encoded by the DNA. If desired, the SECX and/or NOVX polypeptide can then be recovered.

In another aspect, the invention includes a method of detecting the presence of a SECX and/or NOVX polypeptide in a sample. In the method, a sample is contacted with a compound that selectively binds to the polypeptide under conditions allowing for formation of a complex between the polypeptide and the compound. The complex is detected, if present, thereby identifying the SECX and/or NOVX polypeptide within the sample.

The invention also includes methods to identify specific cell or tissue types based on their expression of a SECX and/or NOVX.

Also included in the invention is a method of detecting the presence of a SECX and/or NOVX nucleic acid molecule in a sample by contacting the sample with a SECX and/or NOVX nucleic acid probe or primer, and detecting whether the nucleic acid probe or primer bound to a SECX and/or NOVX nucleic acid molecule in the sample.

In a further aspect, the invention provides a method for modulating the activity of a SECX and/or NOVX polypeptide by contacting a cell sample that includes the SECX and/or NOVX polypeptide with a compound that binds to the SECX polypeptide in an amount sufficient to modulate the activity of said polypeptide. The compound can be, e.g., a small molecule, such as a nucleic acid, peptide, polypeptide, peptidomimetic, carbohydrate, lipid or other organic (carbon containing) or inorganic molecule, as further described herein.

The polynucleotides and polypeptides are used as immunogens to produce antibodies specific for the invention, and as vaccines. They are used to screen for potential agonist and antagonist compounds. For example, a cDNA encoding SECX may be useful in gene therapy, and SECX may be useful when administered to a subject in need thereof. By way of nonlimiting example, the compositions of the present invention will have efficacy for treatment of patients suffering the diseases and disorders listed above and/or other pathologies and disorders.

The invention further includes a method for screening for a modulator of disorders or syndromes including, e.g., diseases and disorders listed above and/or other pathologies and disorders and those disorders related to cell signal processing and metabolic pathway modulation. The method includes contacting a test compound with a SECX polypeptide and determining if the test compound binds to said SECX polypeptide. Binding of the test compound to the SECX polypeptide indicates the test compound is a modulator of activity, or of latency or predisposition to the aforementioned disorders or syndromes.

Also within the scope of the invention is a method for screening for a modulator of activity, or of latency or predisposition to an disorders or syndromes including the diseases and disorders listed above and/or other pathologies and disorders or other disorders related to cell signal processing and metabolic pathway modulation by administering a test compound to a test animal at increased risk for the aforementioned disorders or syndromes. The test animal expresses a recombinant polypeptide encoded by a SECX nucleic acid. Expression or activity of SECX polypeptide is then measured in the test animal, as is expression or activity of the protein in a control animal which recombinantly-expresses SECX polypeptide and is not at increased risk for the disorder or syndrome. Next, the expression of SECX polypeptide in both the test animal and the control animal is compared. A change in the activity of SECX polypeptide in the test animal relative to the control animal indicates the test compound is a modulator of latency of the disorder or syndrome.

In yet another aspect, the invention includes a method for determining the presence of or predisposition to a disease associated with altered levels of a SECX polypeptide, a SECX nucleic acid, or both, in a subject (e.g., a human subject). The method includes measuring the amount of the SECX polypeptide in a test sample from the subject and comparing the amount of the polypeptide in the test sample to the amount of the SECX polypeptide present in a control sample. An alteration in the level of the SECX polypeptide in the test sample as compared to the control sample indicates the presence of or predisposition to a disease in the subject. Preferably, the predisposition includes diseases and disorders listed above and/or other pathologies and disorders. Also, the expression levels of the new polypeptides of the invention can be used in a method to screen for various cancers as well as to determine the stage of cancers.

In a further aspect, the invention includes a method of treating or preventing a pathological condition associated with a disorder in a mammal by administering to the subject a SECX polypeptide, a SECX nucleic acid, or a SECX-specific antibody to a subject (e.g., a human subject), in an amount sufficient to alleviate or prevent the pathological condition. In preferred embodiments, the disorder, includes the diseases and disorders listed above and/or other pathologies and disorders.

In yet another aspect, the invention can be used in a method to identity the cellular receptors and downstream effectors of the invention by any one of a number of techniques commonly employed in the art. These include but are not limited to the two-hybrid system, affinity purification, co-precipitation with antibodies or other specific-interacting molecules.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In the case of conflict, the present specification, including definitions, will control. In addition, the materials, methods, and examples are illustrative only and not intended to be limiting.

Other features and advantages of the invention will be apparent from the following detailed description and claims.

DETAILED DESCRIPTION OF THE INVENTION

The invention is based, in part, upon the discovery of nucleic acid sequences that encode polypeptides. The nucleic acids and their encoded polypeptides are referred to individually as SEC1, SEC2, SEC3, SEC4, SEC5, SEC6, SEC7, SEC8, SEC9, SEC10, SEC11, and SEC12. The nucleic acids, and their encoded polypeptides, are collectively designated herein as "SECX".

The SECX nucleic acids of the invention include the SEC1, SEC2, SEC3, SEC4, SEC5, SEC6, SEC7, SEC8, SEC9, SEC10, SEC11, and SEC12 nucleic acids, or fragments, derivatives, analogs or homologs thereof. The SECX proteins of the invention include the SEC1, SEC2, SEC3, SEC4, SEC5, SEC6, SEC7, SEC8, SEC9, SEC10, SEC11, and SEC12 polypeptides, epitopes or domains thereof, or derivatives, analogs or homologs thereof. The individual SECX nucleic acids and proteins are described below. Within the scope of this invention is a method of using these nucleic acids and peptides in the treatment or prevention of a disorder related to cell signaling, adhesion, or metabolic pathway modulation.

The SECX nucleic acids of the invention include the nucleic acids whose sequences are provided herein, or fragments thereof. The invention also includes mutant or variant nucleic acids any of whose bases may be changed from the corresponding base shown herein while still encoding a protein that maintains its activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject.

The SECX proteins of the invention include the proteins whose sequences are provided herein. The invention also includes mutant or variant proteins any of whose residues may be changed from the corresponding residue shown herein while still encoding a protein that maintains its activities and physiological functions, or a functional fragment thereof. The invention further encompasses antibodies and antibody fragments, such as $F_{ab}$ or $(F_{ab})_2$, that bind immunospecifically to any of the proteins of the invention.

The SECX nucleic acids and proteins are useful in potential therapeutic applications implicated in various pathological disorders, described below. For example, a cDNA encoding the SECX protein may be useful in gene therapy, and the receptor-like protein may be useful when administered to a subject in need thereof. Also within the scope of the invention is the use of a therapeutic in the manufacture of a medicament for treating or preventing disorders or syndromes including, e.g., developmental diseases; MHC I, II and III diseases (immune diseases); taste and scent detectability disorders; Burkitt's lymphoma; corticoneurogenic disease; signal transduction pathway disorders; metabolic pathway disorders; retinal diseases including those involving photoreception; cell growth rate disorders; cell shape disorders; metabolic disorders; feeding disorders; control of feeding; the metabolic syndrome X; wasting disorders associated with chronic diseases; obesity; potential obesity due to over-eating or metabolic disturbances; potential disorders due to starvation (lack of appetite); diabetes; noninsulin-dependent diabetes mellitus (NIDDMI); infectious disease; bacterial, fungal, protozoal and viral infections (particularly infections caused by HIV-1 or HIV-2); pain; cancer (including but not limited to neoplasm; adenocarcinoma; lymphoma; prostate cancer; uterus cancer); cancer-associated cachexia; anorexia; bulimia; asthma; Parkinson's disease; acute heart failure; hypotension; hypertension; urinary retention; osteoporosis; Crohn's disease; multiple sclerosis; Albright hereditary ostoeodystrophy; angina pectoris; myocardial infarction; ulcers; allergies; benign prostatic hypertrophy; and psychotic and neurological disorders; including anxiety; schizophrenia; manic depression; delirium; dementia; neurodegenerative disorders; Alzheimer's disease; severe mental retardation; dentatorubro-pallidoluysian atrophy (DRPLA); hypophosphatemic rickets; autosomal dominant (2) acrocallosal syndrome and dyskinesias, such as Huntington's disease or Gilles de la Tourette syndrome; immune disorders; adrenoleukodystrophy; congenital adrenal hyperplasia; hemophilia; hypercoagulation; idiopathic thrombocytopenic purpura; autoimmume disease; immunodeficiencies; transplantation; Von Hippel-Lindau (VHL) syndrome; stroke; tuberous sclerosis; hypercalceimia; cerebral palsy; epilepsy; Lesch-Nyhan syndrome; ataxia-telangiectasia; leukodystrophies; behavioral disorders; addiction; neuroprotection; cirrhosis; transplantation; systemic lupus erythematosus; emphysema; scleroderma; ARDS; renal artery stenosis; interstitial nephritis; glomerulonephritis; polycystic kidney disease; renal tubular acidosis; IgA nephropathy; cardiomyopathy; atherosclerosis; congenital heart defects; aortic stenosis; atrial septal defect (ASD); atrioventricular (A-V) canal defect; ductus arteriosus; pulmonary stenosis; subaortic stenosis; ventricular septal defect (VSD); valve diseases; scleroderma; fertility; pancreatitis; endocrine dysfunctions; growth and reproductive disorders; inflammatory bowel disease; diverticular disease; graft vesus host disease; hyperthyroidism; endometriosis; hematopoietic disorders and/or other pathologies and disorders of the like.

The polypeptides can be used as immunogens to produce antibodies specific for the invention, and as vaccines. They can also be used to screen for potential agonist and antagonist compounds. For example, a cDNA encoding a SECX protein may be useful in gene therapy, and the SEC-like protein may be useful when administered to a subject in need thereof. By way of nonlimiting example, the anti-SECX antibody compositions of the present invention will have efficacy for treatment of patients suffering from the diseases and disorders listed above, as well as other related or associated pathologies. The nucleic acid encoding SECX protein, and the SECX protein of the invention, or fragments thereof, may further be useful in diagnostic applications, wherein the presence or amount of the nucleic acid or the protein are to be assessed. These materials are further useful in the generation of antibodies that bind immunospecifically to the substances of the invention for use in therapeutic or diagnostic methods.

SEC1

A disclosed SEC1 (alternatively referred to as CG55688-01), comprises CYR61, a secreted, cysteine-rich, heparin-binding protein encoded by a growth factor-inducible immediate-early gene, which includes the 1887 base nucleotide sequence (SEQ ID NO:1) shown in Table 1A. The disclosed SEC1 open reading frame ("ORF") begins at an ATG initiation codon at nucleotides 81–83 and terminates at a ACT codon at nucleotides 1222–1224. Putative untranslated regions upstream from the initiation codon and downstream from the termination codon are underlined in Table 1A, and the start and stop codons are in bold letters.

TABLE 1A

SEC1 polynucleotide sequence.

<u>GCGCACGGCCTGTCCGCTGCACACCAGCTTGTTGGCGTCTTCGTCGCCGCGCTCGCCCCG</u> (SEQ ID NO:1)

<u>GGCTACTCCTGCGCGCCACA</u>ATGAGCTCCCGCATCGCCAGGGCGCTCGCCTTAGTCGTCA

CCCTTCTCCACTTGACCAGGCTGGCGCTCTCCACCTGCCCCGCTGCCTGCCACTGCCCCC

TGGAGGCGCCCAAGTGCGCGCCGGGAGTCGGGCTGGTCCGGGACGGCTGCGGCTGCTGTA

TABLE 1A-continued
SEC1 polynucleotide sequence.

AGGTCTGCGCCAAGCAGCTCAACGAGGACTGCAGCAAAACGCAGCCCTGCGACCACACCA

AGGGGCTGGAATGCAACTTCGGCGCCAGCTCCACCGCTCTGAAGGGGATCTGCAGAGCTC

AGTCAGAGGGCAGACCCTGTGAATATAACTCCAGAATCTACCAAAACGGGGAAAGTTTCC

AGCCCAACTGTAAACATCAGTGCACATGTATTGATGGCGCCGTGGGCTGCATTCCTCTGT

GTCCCCAAGAACTATCTCTCCCCAACTTGGGCTGTCCCAACCCTCGGCTGGTCAAAGTTA

CCGGGCAGTGCTGCGAGGAGTGGGTCTGTGACGAGGATAGTATCAAGGACCCCATGGAGG

ACCAGGACGGCCTCCTTGGTAAGGAGCTGGGATTCGATGCCTCCGAGGTGGAGTTGACGA

GAAACAATGAATTGATTGCAGTTGGAAAAGGCAGCTCACTGAAGCGGATCCCTGTTTTTG

GAATGGAGCCTCGCATCCGATACAACCCTTTACAAGGCCAGAAATGTATTGTTCAAACAA

CTTCATGGTCCCAGTGCTCAAAGACCTGTGGAACTGGTATCTCCACACGAGTTACCAATG

ACAACCCTGAGTGCCGCCTTGTGAAAGAAACCCGGATTTGTGAGGTGCGGCCTTGTGGAC

AGCCAGTGTACAGCAGCCTGAAAAAGGGCAAGAAATGCAGCAAGACCAAGAAATCCCCCG

AACCAGTCAGGTTTACTTACGCTGGATGTTTGAGTGTGAAGAAATACCGGCCCAAGTACT

GCGGTTCCTGCGTGGACGGCCGATGCTGCACGCCCCAGCTGACCAGGACTGTGAAGATGC

GGTTCCGCTGCGAAGATGGGGAGACATTTTCCAAGAACGTCATGATGATCCAGTCCTGCA

AATGCAACTACAACTGCCCGCATGCCAATGAAGCAGCGTTTCCCTTCTACAGGCTGTTCA

ATGACATTCACAAATTTAGGGACTAAATGCTACCTGGGTTTCCAGGGCACACCTAGACAA

ACAAGGGAGAAGAGTGTCAGAATCAGAATCATGGAGAAAATGGGCGGGGGTGGTGTGGGT

GATGGGACTCATTGTAGAAAGGAAGCCTTGCTCATTCTTGAGGAGCATTAAGGTATTTCG

AAACTGCCAAGGGTGCTGGTGCGGATGGACACTAATGCAGCCACGATTGGAGAATACTTT

GCTTCATAGTATTGGAGCACATGTTACTGCTTCATTTTGGAGCTTGTGGAGTTGATGACT

TTCTGTTTTCTGTTTGTAAATTATTTGCTAAGCATATTTTCTCTAGGCTTTTTTCCTTTT

GGGGTTCTACAGTCGTAAAAGAGATAATAAGATTAGTTGGACAGTTTAAAGCTTTTATTC

GTCCTTTGACAAAAGTAAATGGGAGGGCATTCCATCCCTTCCTGAAGGGGACACTCCAT

GAGTGTCTGTGAGAGGCAGCTATCTGCACTCTAAACTGCAAACAGAAATCAGGTGTTTTA

AGACTGAATGTTTTATTTATCAAAATGTAGCTTTTGGGGAGGGAGGGGAAATGTAATACT

GGAATAATTTGTAAATGATTTTAATTTTATATTCAGTGAAAAGATTTTATTTATGGAATT

AACCATTTAATAAAGAAATATTTACCT

The disclosed sequence of SEC1 was derived by laboratory cloning of cDNA fragments, by in silico prediction of the sequence. The cDNA fragments covering either the full length of the DNA sequence, or part of the sequence, or both, were cloned. In silico prediction was based on sequences available in CuraGen's proprietary sequence databases or in the public human sequence databases, and provided either the full length DNA sequence, or some portion thereof.

The disclosed SEC1 of this invention maps to chromosome 1p22.3. Chromosome localization information was assigned using OMIM, the electronic northern bioinformatic tool implemented by CuraGen Corporation, public ESTs, public literature references and/or genomic clone homologies. This was executed to derive the chromosomal mapping of the SeqCalling assemblies, Genomic clones, literature references and/or EST sequences that were included in the invention.

The disclosed SEC1 polypeptide (SEQ ID NO:2) encoded by SEQ ID NO:1 has 381 amino acid residues, and is presented in Table 1B using the one-letter amino acid codes. The Psort profile for SEC1 predicts that this sequence has a signal peptide and is likely to be localized outside the cell with a certainty of 0.5422. In alternative embodiments, a SEC1 polypeptide is located to the endoplasmic reticulum (membrane) with a certainty of 0.1000, to the endoplasmic reticulum (lumen) with a certainty of 0.1000, or to lysosomes with a certainty of 0.1000. The Signal P predicts a likely cleavage site for a SEC1 peptide is between positions 24 and 25, i.e., at the dash in the sequence ALS-TC.

TABLE 1B

Encoded SEC1 polypeptide sequence.

MSSRIARALALVVTLLHLTRLALSTCPAACHCPLEAPKCAPGVGLVRDGCGCCKVCAKQL    (SEQ ID NO:2)

NEDCSKTQPCDHTKGLECNFGASSTALKGICRAQSEGRPCEYNSRIYQNGESFQPNCKHQ

CTCIDGAVGCIPLCPQELSLPNLGCPNPRLVKVTGQCCEEWVCDEDSIKDPMEDQDGLLG

KELGFDASEVELTRNNELIAVGKGSSLKRIPVFGMEPRIRYNPLQGQKCIVQTTSWSQCS

KTCGTGISTRVTNDNPECRLVKETRICEVRPCGQPVYSSLKKGKKCSKTKKSPEPVRFTY

AGCLSVKKYRPKYCGSCVDGRCCTPQLTRTVKMRFRCEDGETFSKNVMMIQSCKCNYNCP

HANEAAFPFYRLFNDIHKFRD

Public and proprietary sequence databases were searched for protein sequences with homology to SEC1 using BLASTP software. In all BLAST alignments herein, the "E-value" or "Expect" value is a numeric indication of the probability that the aligned sequences could have achieved their similarity to the BLAST query sequence by chance alone, within the database that was searched. The Expect value (E) is a parameter that describes the number of hits one can "expect" to see just by chance when searching a database of a particular size. It decreases exponentially with the Score (S) that is assigned to a match between two sequences of a database of comparable complexity. Essentially, the E value describes the random background noise that exists for matches between sequences.

The E value is used as a convenient way to create a significance threshold for reporting results. The default value used for blasting is typically set to 0.0001. In BLAST 2.0, the E value is also used instead of the P value (probability) to report the significance of matches. For example, an E value of one assigned to a hit can be interpreted as meaning that in a database of the current size one might expect to see one match with a similar score simply by chance. An E value of zero means that one would not expect to see any matches with a similar score simply by chance. See, e.g., http://www.ncbi.nlm.nih.gov/Education/BLASTinfo/. Occasionally, a string of X's or N's will result from a BLAST search. This is a result of automatic filtering of the query for low-complexity sequence that is performed to prevent artifactual hits. The filter substitutes any low-complexity sequence that it finds with the letter "N" in nucleotide sequence (e.g., "NNNNNNNNN") or the letter "X" in protein sequences (e.g., "XXX"). Low-complexity regions can result in high scores that reflect compositional bias rather than significant position-by-position alignment (Wootton and Federhen, *Methods Enzymol* 266:554–571, 1996).

A BLAST analysis of SEC1 was run against the proprietary PatP GENESEQ Protein Patent database. The amino acid sequence of SEC1 has high homology to other proteins as shown in Table 1C.

TABLE 1C

BLASTX results from PatP database for SEC1

| Sequences producing High-scoring Segment Pairs: | High Score | Smallest Sum Probability P(N) |
|---|---|---|
| patp: AAB43987 Human cancer associated protein | 2107 | 2.1e−219 |
| patp: AAW35957 Human monocyte mature differentiation factor | 2107 | 6.6e−218 |
| patp: AAB90773 Human shear stress-response protein | 2107 | 6.6e−218 |
| patp: AAW35730 Human cysteine rich protein 61 (Cyr61) | 2098 | 5.9e−217 |
| patp: AAE05921 Human cysteine-rich protein (Cyr61) | 2098 | 5.9e−217 |

In a search of public sequence databases, it was found, for example, that the amino acid sequence of the protein of the invention was found to have 381 of 381 amino acid residues (100%) identical to the 381 amino acid CYR61 protein from Homo sapiens (NM_001554 protein, E=1.3e-93).

SEC1 also has homology to the other proteins shown in the BLASTP data in Table 1D.

TABLE 1D

SEC1 BLASTP results

| Gene Index/Identifier | Protein/Organism | Length (aa) | Identity (%) | Positive (%) | Expect |
|---|---|---|---|---|---|
| gi\|4504613\|ref\|NP_001545.1\| (NM_001554) | cysteine-rich, angiogenic inducer, 61; cysteine-rich heparin-binding protein 61; cysteine-rich, anigogenic inducer, 61 [*Homo sapiens*] | 381 | 381/381 (100) | 381/381 (100) | 0.0 |
| gi\|13638596\|ref\|XP_001831.2\| (XM_001831) | cysteine-rich, angiogenic inducer, 61 [*Homo sapiens*] | 381 | 379/381 (99) | 380/381 (99) | 0.0 |
| gi\|2791898\|emb | CYR61 protein | 381 | 378/381 | 380/381 | 0.0 |

TABLE 1D-continued

SEC1 BLASTP results

| Gene Index/Identifier | Protein/Organism | Length (aa) | Identity (%) | Positive (%) | Expect |
|---|---|---|---|---|---|
| |CAA72167.1| (Y11307) | [Homo sapiens] | | (99) | (99) | |
| gi|12584866 gb |AAG59863.1| AF307860_1 (AF307860) | CYR61 protein [Homo sapiens] | 381 | 378/381 (99) | 379/381 (99) | 0.0 |
| gi|6753594|ref |NP_034646.1| (NM_010516) | cysteine rich protein 61; insulin-like growth factor binding protein 10; intermediate early gene [Mus musculus] | 379 | 344/383 (89) | 352/383 (91) | e−166 |

A sequence alignment is given in Table 1E, with the SEC1 protein being shown on line 1 in a ClustalW analysis comparing the protein of the invention with the related protein sequences shown in Table 1D.

TABLE 1E

ClustalW

1) SEC1        (SEQ ID NO:2)
2) gi|4504613|  (SEQ ID NO:41)
3) gi|13638596| (SEQ ID NO:42)
4) gi|12584866| (SEQ ID NO:43)
5) gi|6753594|  (SEQ ID NO:44)
6) gi|6753594|  (SEQ ID NO:45)

```
                        10        20        30        40        50
                ....|....|....|....|....|....|....|....|....|....|
SEC1            MSSRIARALALVVTLLHLTRLALSTCPAACHCPLEAPKCAPGVLVRDGC
gi|4504613|     MSSRIARALALVVTLLHLTRLALSTCPAACHCPLEAPKCAPGVLVRDGC
gi|13638596|    MSSRIARALALVVTLLHLTRLALSTCPAACHCPLEAPKCAPGVLVRDGC
gi|2791898|     MSSRIARALALVVTLLHLTRLALSTCPAACHCPLEAPKCAPGVLVRDGC
gi|12584866|    MSSRIARALALVVTLLHLTRLALSTCPAACHCPLEAPKCAPGVLVRDGC
gi|6753594|     MSSSTFRTLAVAVTLLHLTRLALSTCPAACHCPLEAPKCAPGVLVRDGC 60        70        80        90       100
                ....|....|....|....|....|....|....|....|....|....|
SEC1            GCCKVCAKQLNEDCSKTQPCDHTKGLECNFGASSTALKGICRAQSEGRPC
gi|4504613|     GCCKVCAKQLNEDCSKTQPCDHTKGLECNFGASSTALKGICRAQSEGRPC
gi|13638596|    GCCKVCAKQLNEDCSKTQPCDHTKGLECNFGASSTALKGICRAQSEGRPC
gi|2791898|     GCCKVCAKQLNEDCSKTQPCDHTKGLECNFGASSTALKGICRAQSEGRPC
gi|12584866|    GCCKVCAKQLNEDCSKTQPCDHTKGLECNFGASSTALKGICRAQSEGRPC
gi|6753594|     GCCKVCAKQLNEDCSKTQPCDHTKGLECNFGASSTALKGICRAQSEGRPC 110       120       130       140       150
                ....|....|....|....|....|....|....|....|....|....|
SEC1            EYNSRIYQNGESFQPNCKHQCTCIDGAVGCIPLCPQELSLPNLGCPNPRL
gi|4504613|     EYNSRIYQNGESFQPNCKHQCTCIDGAVGCIPLCPQELSLPNLGCPNPRL
gi|13638596|    EYNSRIYQNGESFQPNCKHQCTCIDGAVGCIPLCPQELSLPNLGCPNPRL
gi|2791898|     EYNSRIYQNGESFQPNCKHQCTCIDGAVGCIPLCPQELSLPNLGCPNPRL
gi|12584866|    EYNSRIYQNGESFQPNCKHQCTCIDGAVGCIPLCPQELSLPNLGCPNPRL
gi|6753594|     EYNSRIYQNGESFQPNCKHQCTCIDGAVGCIPLCPQELSLPNLGCPNPRL 160       170       180       190       200
                ....|....|....|....|....|....|....|....|....|....|
SEC1            VKVTGQCCEEWVCDEDSIKDPMEDQDGLLGKELGFDASEVELTRNNELIA
gi|4504613|     VKVTGQCCEEWVCDEDSIKDPMEDQDGLLGKELGFDASEVELTRNNELIA
gi|13638596|    VKVTGQCCEEWVCDEDSIKDPMEDQDGLLGKELGFDASEVELTRNNELIA
gi|2791898|     VKVTGQCCEEWVCDQDSIKDPMEDQDGLLGKELGFDASEVELTRNNELIA
gi|12584866|    VKVTGQCCEEWVCDEDSIKDPMEDQDGLLGKELGFDASEVELTRNNELIA
gi|6753594|     VKVSGQCCEEWVCDEDSIKDSEDQDDLLG----LDASEVELTRNNELIA 210       220       230       240       250
                ....|....|....|....|....|....|....|....|....|....|
SEC1            VGKGSSLKRIPVFGMEPRIRYNPLQ--GQKCIVQTTSWSQCSKTCGTGIS
gi|4504613|     VGKGSSLKRIPVFGMEPRIRYNPLQ--GQKCIVQTTSWSQCSKTCGTGIS
gi|13638596|    VGKGSSLKRLPVFGMEPRILYNPLQ--GQKCIVQTTSWSQCSKTCGTGIS
gi|2791898|     VGKGSSLKRLPVFGMEPRILYNPLQ--GQKCIVQTTSWSQCSKTCGTGIS
gi|12584866|    VGKGSSLKRLPVFGMEPRILYNPLQ--GQKCIVQTTSWSQCSKTCGTGIS
gi|6753594|     IGKGSSLKRLPVFGTEPRVLRNPLHAHGQKCIVQTTSWSQCSKSCGTGIS
```

TABLE 1E-continued

ClustalW

```
                       260        270        280        290        300
               ....|....|....|....|....|....|....|....|....|....|
SEC1           TRVTNDNPECRLVKETRICEVRPCGQPVYSSLKKGKKCSKTKKSPEPVRF
gi|4504613|    TRVTNDNPECRLVKETRICEVRPCGQPVYSSLKKGKKCSKTKKSPEPVRF
gi|13638596|   TRVTNDNPECRLVKETRICEVRPCGQPVYSSLKKGKKCSKTKKSPEPVRF
gi|2791898|    TRVTNDNPECRLVKETRICEVRPCGQPVYSSLKKGKKCSKTKKSPEPVRF
gi|12584866|   TRVTNDNPECRLVKETRICEVRPCGQPVYSSLKKGKKCSKTKKSPEPVRF
gi|6753594|    TRVTNDNPECRLVKETRICEVRPCGQPVYSSLKKGKKCSKTKKSPEPVRF 310        320        330        340        350
               ....|....|....|....|....|....|....|....|....|....|
SEC1           TYAGCLSVKKYRPKYCGSCVDGRCCTPQLTRTVKMRFRCEDGETFSKNVM
gi|4504613|    TYAGCLSVKKYRPKYCGSCVDGRCCTPQLTRTVKMRFRCEDGETFSKNVM
gi|13638596|   TYAGCLSVKKYRPKYCGSCVDGRCCTPQLTRTVKMRFRCEDGETFSKNVM
gi|2791898|    TYAGCLSVKKYRPKYCGSCVDGRCCTPQLTRTVKMRFRCEDGETFSKNVM
gi|12584866|   TYAGCLSVKKYRPKYCGSCVDGRCCTPQLTRTVKMRFRCEDGETFSKNVM
gi|6753594|    TYAGCSSVKKYRPKYCGSCVDGRCCTPLQTRTVKMRFRCEDGEMFSKNVM 360        370        380
               ....|....|....|....|....|....|...
SEC1           MIQSCKCNYNCPHANEAAFPFYRLFNDIHKFRD
gi|4504613|    MIQSCKCNYNCPHANEAAFPFYRLFNDIHKFRD
gi|13638596|   MIQSCKCNYNCPHANEAAFPFYRLFNDIHKFRD
gi|2791898|    MIQSCKCNYNCPHANEAAFPFYRLFNDIHKFRD
gi|12584866|   MIQSCKCNYNCPHANEAAFPLYRLFNDIHKFRD
gi|6753594|    MIQSCKCNYNCPHENEASFRLYSLFNDIHKFRD
```

Domain Analysis

The presence of identifiable domains in SEC1, as well as all other SECX proteins, was determined by searches using software algorithms such as PROSITE, DOMAIN, Blocks, Pfam, ProDomain, and Prints, and then determining the Interpro number by crossing the domain match (or numbers) using the Interpro website (http:www.ebi.ac.uk/interpro). DOMAIN results for SEC1 as disclosed in Table 1F, were collected from the Conserved Domain Database (CDD) with Reverse Position Specific BLAST analyses. This BLAST analysis software samples domains found in the Smart and Pfam collections. For Table 1F and all successive DOMAIN sequence alignments, fully conserved single residues are indicated by the sign (|) and "strong" semi-conserved residues are indicated by the sign (+). The "strong" group of conserved amino acid residues may be any one of the following groups of amino acids: STA, NEQK, NHQK, NDEQ, QHRK, MILV, MILF, HY, FYW.

Table 1F lists the domain description from DOMAIN analysis results against SEC1. This indicates that the SEC1 sequence has properties similar to those of other proteins known to contain this domain.

CYR61 is a secreted, cysteine-rich, heparin-binding protein encoded by a growth factor-inducible immediate-early gene. Acting as an extracellular matrix-associated signaling molecule, CYR61 is an angiogenic inducer that promotes the adhesion of endothelial cells through interaction with integrins and augments growth factor-induced DNA synthesis in the same cell type (see, Expression of cyr61, a growth factor-inducible immediate-early gene. O'Brien T P, et al., Mol Cell Biol. 1990 July;10(7):3569–77, incorporated by reference). CYR61 stimulates directed migration of human microvascular endothelial cells in culture through the alpha (V)beta(3)-dependent pathway and induces neovascularization of the surrounding tissues. Modulation of CYR61 provides for methods of treating disorders of angiogenesis. For example, specific anti-CYR61 antibodies are useful to block both the chemotactic and angiogenic activities of CYR61, and provide a method for detection of the CYR61 polypeptide in disease states, for example, in the detection and treatment of tumorigenesis. Upregulation or expression of CYR61 is useful to promote neovascularization, for example, to promote wound healing or in transplant grafts.

Through a proprietary technology designed to identify transcripts of all expressed genes, a cDNA designated CG55688-01 was isolated. In vitro, the recombinant protein

TABLE 1F

Domain Analysis of SEC1

```
gnl|Pfam|pfam00007, Cys_knot, Cystine-knot domain. The family comprises
glycoprotein hormones and the C-terminal domain of various extracellular proteins.
CD-Length=109 residues, 89.0% aligned
Score=51.6 bits (122), Expect=8e-08

SEC 1:   293 PEPVRFTYAGCLSVKKYRPKYC-GSCVD--------------GRCCTPQLTRTVKMRFRC 337 (SEQ ID NO: 299)
             +     GC S K    C G C              CC P +T   K+   C
Sbjct:    12 NVTISVEKEGCTSCKTVNTTICAGYCYTKDPVYKDGRSLLIQCVCCYPDVTYETKVLPGC  71

SEC 1:   338 EDGETFSKNVMMIQSCKCNYNCPHANEAAFPFYRLFND 375
                  G  +K  +  SC C    C   N         +
Sbjct:    72 PPGVDPTKTYPVALSCHCG-KCNTDNTDCTRLSLQPDS 108
``` was systematically tested in a number of endothelial cell assays and found to induce a critical process involved in the angiogenic cascade. First, CG55688-01 did not inhibit VEGF/bFGF-mediated proliferation or by itself induce endothelial proliferation. However, CG55688-01 significantly enhanced endothelial cell migration through enhanced matrix adhesion. These findings reveal a function for CG55688-01 as playing a role in a key process of angiogenesis. The molecule is a target for small molecules or antibodies as a cancer therapeutic or other diseases, such as psoriasis, for example, where inflammation is enhanced by increased vascularization. Alternatively, CG55688 is a therapeutic useful in wound healing, stroke or cardiovascular diseases.

Expression Purification and Biochemical Characterization of Recombinant SEC1

The CG55688-01 nucleic acid sequence disclosed as SEQ ID NO 1 was cloned into the pCEP4 vector (Invitrogen, Carlsbad, Calif.) and was transfected into HEK293T cells using Lipofectamine Plus reagent according to manufacturer's instructions (Life Technologies Inc., Rockville, Md.). The cell pellet and supernatant were harvested 72 h after transfection and examined for protein expression by Western blot analysis with an anti-V5 monoclonal antibody. After initial confirmation of expression, large-scale transfections were carried out in 150-cm$^2$ petri dishes using Lipofectamine Plus reagent. The conditioned medium was collected from the transfected cells after 72 h, pooled and loaded onto a Ni$^{2+}$ affinity column according to manufacturer's instructions (Qiagen, Valencia, Calif.). The column was washed with 10 column volumes of PBS, pH 7.4 containing 500 mM NaCl. Non-specifically bound proteins were washed with above buffer containing 5 mM imidazole. The bound proteins were eluted with PBS, pH 7.4 containing 500 mM imidzaole. Peak fractions from the 500 mM imidazole peak were pooled and dialyzed overnight in PBS, pH 7.4. The protein was further purified by a second round of purification over a Ni$^{2+}$ affinity column and dialyzed against PBS, pH 7.4. The concentration of protein was measured by the Bradford reagent (Bio-Rad, Hercules, Calif.). Protein purity was assessed by Coomassie Brilliant Blue staining after analysis by SDS-PAGE on a 4–15% Tris/glycine gradient gel. Purified CG55688-01 was also transferred to PVDF membrane and subsequently processed for 15 cycles of N-terminal sequence analysis. In addition, the purified protein was tested for endotoxin using the Gel clot method (Cape Cod Associates, CapeCod, Mass.) and found to have <10 EU/mg of protein. Subsequently, the purified protein was used in all in vitro angiogenesis assays.

Endothelial Cell BrdU Incorporation Assay

Purified CG55688-01 was tested for its ability to induce or inhibit the proliferation of endothelial cells using a BrdU incorporation assay. Proliferative activity is measured by treatment of serum-starved cultured cells with a given agent and measurement of BrdU incorporation during DNA synthesis. The proliferative and antiproliferative effect of CG55688-01 was assessed using HUVEC and HMVEC-d. Cells were seeded into wells at 4×10$^4$ cells/well, were synchronized by serum starvation overnight in minimal medium (0.5% FBS) and stimulated with VEGF and bFGF at 10 ng/ml in the presence of 1% FBS. Different concentrations of purified protein were added along with VEGF, and incubated for 18 hours. BrdU was then added, a 4-hour incubation allowed, and ELISA was performed. The cells were plated in 96-well flat bottom plates pre-coated with Attachment Factor (Cascade Biologics, Portland, Oreg.) at 3×10$^4$ cells/well in 100 μl of Medium 200 (Cascade Biologics, Portland, Oreg.) containing 0.5% FBS. After 24 hours of starvation at 37° C., the cells were washed twice with serum-free medium, and then fed with fresh medium containing 1% FBS with VEGF$_{165}$ and bFGF (10 ng/ml) (R & D Systems, Minneapolis, Minn.) with and without CG55688-01 protein. The cells were pulsed with BrdU for 4 hours before harvest. The BrdU assay was performed according to the manufacturer's specification (Roche Molecular Biochemicals, Indianapolis, Ind.).

Migration Assay

To determine the ability of recombinant CG55688-01 to block migration of HUVEC and HMVEC-d towards VEGF$_{165}$, 24-well transwell (BD Biosciences, Bedford, Mass.) migration chambers having an 8 μm pore size were used. The transwells were coated with 10 μg/ml of Type I collagen (BD Biosciences, Bedford, Mass.) from rat tail for 1 h at 37° C. After washing with PBS, the wells were seeded with HUVEC suspended at 2×10$^7$ cells/ml in Medium 200 containing 1% BSA (Sigma Chemicals, St Louis, Mo.). The lower chambers (600 μl) were filled with Medium 200 containing 1% FBS supplemented with 10 ng/ml of recombinant VEGF$_{165}$. The upper chamber was seeded with 4×10$^4$ cells/well in 200 μl containing different concentrations of CG55688-01. Cells were allowed to migrate for 4 h at 37° C. Following incubation, cells on the upper surface of the membrane (non-migrated cells) were scraped with a cotton swab. Cells on the lower side of the membrane (migrated cells) were stained with 0.2% Crystal Violet dye (Fisher Scientific, Springfield, N.J.) in 70% ethanol for 30 min. The cells were then destained in PBS, pH 7.4 and the membrane was left to air dry at room temperature. The number of cells that had migrated was counted using a Zeiss Axiovert 100 inverted microscope at three independent areas and the mean number of migrated cells was calculated. RGD control peptide (Life Technologies Inc., Rockville, Md.) was used as a positive control for each experiment. The number of cells migrating in the presence or absence of CG55688-01 was counted in three independent fields. The number of cells migrated in the presence of 1% FBS with VEGF (10 ng/ml) was considered as maximum migration and the percentage of inhibition was calculated. The results demonstrate that CG55688-01 specifically affects migration of large and small vessel endothelial cells.

Endothelial Cell Adhesion Assay

Untreated 96-well flat bottom tissue culture plates (Fisher Scientific, Springfield, N.J.) were used in the cell adhesion assay. The plates were coated with 10 μg/ml of different extracellular matrix (ECM) proteins (Type I collagen, Type IV collagen, fibronectin, vitronectin, laminin and Matrigel) overnight at 4° C. The remaining protein binding sites were blocked with 1% BSA in PBS, pH 7.4 for 2 h at 37° C. HUVEC were grown to subconfluence (70–80%) in Medium 200. The cells were labeled with Calcein-AM fluorophore (Molecular Probes, Eugene, Oreg.) as described by the manufacturer. The cells were trypsinized, washed and resuspended at 1.5×10$^5$ cells/ml in serum-free medium containing 1% BSA. The cells were then mixed with different concentrations of CG55688-01 or the absence of CG55688-01 in 100-μl volumes containing 2×10$^4$ cells/treatment for 15 min at room temperature. After incubation, the cell suspension was then added to each well and the plates were incubated at 37° C. for 45 min in 5% CO$_2$. At the end of the incubation period, unattached cells were removed by washing 3 times with serum-free medium, and attached cells were counted using a Cytofluor 4000 flurometer (PE Applied Biosystems, Foster City, Calif.). The number of attached cells was represented as percentage of endothelial cell adhesion.

Typically, greater than 90% of cells were labeled with Calcein AM fluorescence dye. In the presence of different concentrations of CG55688-01, there was a dose-enhancement of cell adhesion to ECM-coated plates indicating that CG55688-01 enhances endothelial cell adhesion to different ECM proteins, with the most pronounced effect observed on fibronectin and vitronectin.

The disclosed SEC1 comprises several domains, such as the following InterPro Domains: cystine-knot domain, C-terminal cystine knot-like domain (CTCK), von Willebrand factor (vWF) type C domain, and Insulin growth factor-binding protein homologues. The homologies shown in the tables, and disclosed above indicates that the SEC1 sequences of the invention have properties similar to those of other proteins known to contain this/these domain(s) as well as properties similar to the properties of these domains.

The CYR61 disclosed herein as SEC1 is expressed in at least the following tissues: apical microvilli of the retinal pigment epithelium, arterial (aortic), basal forebrain, brain, Burkitt lymphoma cell lines, corpus callosum, cardiac (atria and ventricle), caudate nucleus, CNS and peripheral tissue, cerebellum, cerebral cortex, colon, cortical neurogenic cells, endothelial (coronary artery and umbilical vein) cells, palate epithelia, eye, neonatal eye, frontal cortex, fetal hematopoietic cells, heart, hippocampus, hypothalamus, leukocytes, liver, fetal liver, lung, lung lymphoma cell lines, fetal lymphoid tissue, adult lymphoid tissue, those that express MHC I, II, and III, nervous tissues, medulla, subthalamic nucleus, ovary, pancreas, pituitary, placenta, pons, prostate, putamen, serum, skeletal muscle, small intestine, smooth muscle (coronary artery in aortia) spinal cord, spleen, stomach, taste receptor cells of the tongue, testis, thalamus, and thymus tissue. This information was derived by determining the tissue sources of the sequences that were included in the invention including but not limited to Seq-Calling sources, public EST sources, literature sources, and/or RACE sources. Further expression data for SEC1 is provided in Example 2.

The nucleic acids and proteins of SEC1 are useful in potential therapeutic applications implicated in various pathological disorders described above. The SEC1 nucleic acid encoding the CYR61-like protein of the invention, or fragments thereof, is useful in diagnostic applications, wherein the presence or amount of the nucleic acid or the protein is assessed. These materials are further useful in the generation of antibodies that bind immunospecifically to the substances of the invention for use in therapeutic or diagnostic methods. These antibodies may be generated according to methods known in the art, using prediction from hydrophobicity charts, as described in the "Anti-SECX Antibodies" section below. The disclosed SEC1 protein has multiple hydrophilic regions, each of which can be used as an immunogen. In one embodiment, for example, a contemplated SEC1 epitope comprises from about amino acids 60 to about 80. In another embodiment, for example, a SEC1 epitope comprises from about amino acids 85 to about 130. In further embodiments, for example, a SEC1 epitope comprises from about 131 to about 205, and from about 207 to about 381.

SEC2

The disclosed SEC2 (alternatively referred to herein as CG54933-01) includes the 2114 nucleotide sequence (SEQ ID NO:3) shown in Table 2A. A SEC2 ORF begins with a Kozak consensus ATG initiation codon at nucleotides 100–102 and ends with a TGA codon at nucleotides 1984–1986. Putative untranslated regions upstream from the initiation codon and downstream from the termination codon are underlined in Table 2A, and the start and stop codons are in bold letters.

TABLE 2A

SEC2 Nucleotide Sequence

AGGAATTCCGGTGGCCGGCCACTCCCGTCTGCTGTGACGCGCGGACAGAGAGCTACCGGT (SEQ ID NO:3)

GGACCCACGGTGCCTCCCTCCCTGGGATCTACACAGACCATGGCCTTGCAACGGCTCGAC

CCCTGTTGGTCCTGTGGGGACCGCCCTGGCAGCCTCCTGTTCCTGCTCTTCAGCCTCGGA

TGGGTGCATCCCGCGAGGACCCTGGCTGGAGAGACAGGGACGGAGTCTGCCCCCCTGGGG

GGAGTCCTGACAACCCCCCATAACATTTCCAGCCTCTCCCCTCGCCAACTCCTTGGCTTC

CCGTGTGCGGAGGTGTCCGGCCTGAGCACGGAGCGTGTCCGGGAGCTGGCTGTGGCCTTG

GCACAGAAGAATGTCAAGCTCTCAACAGAGCAGCTGCGCTGTCTGGCTCACCGGCTCTCT

GAGCCCCCCGAGGACCTGGACGCCCTCCCATTGGACCTGCTGCTATTCCTCAACCCAGAT

GCGTTCTCGGGGCCCCAGGCCTGCACCCGTTTCTTCTCCCGCATCACGAAGGCCAATGTG

GACCTGCTCCCGAGGGGGGCTCCCGAGCGACAGCGGCTGCTGCCTGCGGCTCTGGCCTGC

TGGGGTGTGCGGGGGTCTCTGCTGAGCGAGGCTGATGTGCGGGCTCTGGGAGGCCTGGCT

TGCGACCTGCCTGGGCGCTTTGTGGCCGAGTCGGCCGAAGTGCTGCTACCCCGGCTGGTG

AGCTGCCCGGGACCCCTGGACCAGGACCAGCAGGAGGCAGCCAGGGCGGCTCTGCAGGGC

GGGGGACCCCCCTACGGCCCCCCGTCGACATGGTCTGTCTCCACGATGGACGCTCTGCGG

GGCCTGCTGCCCGTGCTGGGCCAGCCCATCATCCGCAGCATCCCGCAGGGCATCGTGGCC

GCGTGGCGGCAACGCTCCTCTCGGGACCCATCCTGGCGGCAGCCTGAACGGACCATCCTC

TABLE 2A-continued

SEC2 Nucleotide Sequence

CGGCCGCGGTTCCGGCGGGAAGTGGAGAAGACAGCCTGTCCTTCAGGCAAGAAGGCCCGC

GAGATAGACGAGAGCCTCATCTTCTACAAGAAGTGGGAGCTGGAAGCCTGCGTGGATGCG

GCCCTGCTGGCCACCCAGATGGACCGCGTGAACGCCATCCCCTTCACCTACGAGCAGCTG

GACGTCCTAAAGCATAAACTGGATGAGCTCTACCCACAAGGTTACCCCGAGTCTGTGATC

CAGCACCTGGGCTACCTCTTCCTCAAGATGAGCCCTGAGGACATTCGCAAGTGGAATGTG

ACGTCCCTGGAGACCCTGAAGGCTTTGCTTGAAGTCGACAAAGGGCACGAAATGAGTCCT

CAGGCTCCTCGGCGGCCCCTCCCACAGGTGGCCACCCTGATCGACCGCTTTGTGAAGGGA

AGGGGCCAGCTAGACAAAGACACCCTAGACACCCTGACCGCCTTCTACCCTGGGTACCTG

TGCTCCCTCAGCCCCGAGGAGCTGAGCTCCGTGCCCCCCAGCAGCATCTGGGCGGTCAGG

CCCCAGGACCTGGACACGTGTGACCCAAGGCAGCTGGACGTCCTCTATCCCAAGGCCCGC

CTTGCTTTCCAGAACATGAACGGGTCCGAATACTTCGTGAAGATCCAGTCCTTCCTGGGT

GGGGCCCCCACGGAGGATTTGAAGGCGCTCAGTCAGCAGAATGTGAGCATGGACTTGGCC

ACGTTCATGAAGCTGCGGACGGATGCGGTGCTGCCGTTGACTGTGGCTGAGGTGCAGAAA

CTTCTGGGACCCCACGTGGAGGGCCTGAAGGCGGAGGAGCGGCACCGCCCGGTGCGGGAC

TGGATCCTACGGCAGCGGCAGGACGACCTGGACACGCTGGGGCTGGGGCTACAGGGCGGC

ATCCCCAACGGCTACCTGGTCCTAGACCTCAGCGTGCAAGAGACCCTCTCGGGGACGCCC

TGCCTCCTAGGACCTGGACCTGTTCTCACCGTCCTGGCACTGCTCCTAGCCTCCACCCTG

GCCTGAGGGCCCCACTCCCTTGCTGGCCCCAGCCCTGCTGGGGATCCCCGCCTGGCCAGG

AGCAGGCACGGGTGATCCCCGTTCCACCCCAAGAGAACTCGCGCTCAGTAAACGGGAACA

TGCCCCCTGCAGAC

The SEC2 polypeptide (SEQ ID NO:4) encoded by SEQ ID NO:3 is 628 amino acids in length and is presented using the one-letter amino acid code in Table 2B. The Psort profile for SEC2 predicts that this sequence has a signal peptide and is likely to be localized at the plasma membrane with a certainty of 0.9190. In alternative embodiments, a SEC2 polypeptide is located to lysosomes with a certainty of 0.3000, to the endoplasmic reticulum (membrane) with a certainty of 0.1000, or to the nucleus with a certainty of 0.1800. The Signal P predicts a likely cleavage site for a SEC2 peptide is between positions 34 and 35, i.e., at the dash in the sequence ART-LA.

TABLE 2B

SEC2 protein sequence

MALQRLDPCWSCGDRPGSLLFLLFSLGWVHPARTLAGETGTESAPLGGVLTTPHNISSLS (SEQ ID NO:4)

PRQLLGFPCAEVSGLSTERVRELAVALAQKNVKLSTEQLRCLAHRLSEPPEDLDALPLDL

LLFLNPDAFSGPQACTRFFSRITKANVDLLPRGAPERQRLLPAALACWGVRGSLLSEADV

RALGGLACDLPGRFVAESAEVLLPRLVSCPGPLDQDQQEAARAALQGGGPPYGPPSTWSV

STMDALRGLLPVLGQPIIRSIPQGIVAAWRQRSSRDPSWRQPERTILRPRFRREVEKTAC

PSGKKAREIDESLIFYKKWELEACVDAALLATQMDRVNAIPFTYEQLDVLKHKLDELYPQ

GYPESVIQHLGYLFLKMSPEDIRKWNVTSLETLKALLEVDKGHEMSPQAPRRPLPQVATL

IDRFVKGRGQLDKDTLDTLTAFYPGYLCSLSPEELSSVPPSSIWAVRPQDLDTCDPRQLD

VLYPKARLAFQNMNGSEYFVKIQSFLGGAPTEDLKALSQQNVSMDLATFMKLRTDAVLPL

TVAEVQKLLGPHVEGLKAEERHRPVRDWILRQRQDDLDTLGLGLQGGIPNGYLVLDLSVQ

ETLSGTPCLLGPGPVLTVLALLLASTLA

A BLAST analysis of SEC2 was run against the proprietary PatP GENESEQ Protein Patent database. It was found, for example, that the amino acid sequence of SEC2 had high homology to other proteins as shown in Table 2C.

TABLE 2C

BLASTX results from PatP database for SEC2

| Sequences producing High-scoring Segment Pairs: | High Score | Smallest Sum Probability P(N) |
|---|---|---|
| patp: AAW26674 Human CAK1 antigen (mesothelin) | 3261 | 0.0 |
| patp: AAR53992 Megakaryoctye potentiator | 3047 | 1.8e−317 |
| patp: AAB08544 Mesothelin related antigen (MRA) | 1538 | 1.3e−157 |

TABLE 2C-continued

BLASTX results from PatP database for SEC2

| Sequences producing High-scoring Segment Pairs: | High Score | Smallest Sum Probability P(N) |
|---|---|---|
| patp: AAB08547 Soluble mesothelin related (SMR) | 1538 | 1.3e−157 |
| patp: AAB08543 Mesothelin related antigen (MRA) | 1522 | 6.5e−156 |

In a search of public sequence databases, it was found, for example, that the amino acid sequence of the SEC2 protein of the present invention was found to have 614 of 614 amino acid residues (100%) identical to the 628 amino acid NM-013404 protein from Homo sapiens. SEC2 also has homology to the other proteins shown in the BLASTP data in Table 2D.

TABLE 2D

SEC2 BLASTP results

| Gene Index/Identifier | Protein/Organism | Length (aa) | Identity (%) | Positive (%) | Expect |
|---|---|---|---|---|---|
| gi\|7108356\|ref\|NP_037536.1\| (NM_013404) | mesothelin isoform 2 precursor; mesothelin isoform 1 precursor; megakaryocyte potentiating factor [Homo sapiens] | 628 | 614/614 (100) | 614/614 (100) | 0.0 |
| gi\|13751645\|emb\|CAC37289.1\| (AL031258) | C335H7.1 (mesothelin) [Homo sapiens] | 630 | 590/605 (97) | 594/605 (97) | 0.0 |
| gi\|5031917\|ref\|NP_005814.1\| (NM_005823) | megakaryocyte potentiating factor precursor; mesothelin isoform 1 precursor; megakaryocyte potentiating factor [Homo sapiens] | 622 | 583/605 (96) | 585/605 (96) | 0.0 |
| gi\|14336721\|gb\|AAK61253.1\| AE006464_21 (AE006464) | pre-pro-megakarycyte potentiating factor precursor [Homo sapiens] | 622 | 582/605 (96) | 586/605 (96) | 0.0 |
| gi\|14424505\|gb\|AAH09272.1\| AAH09272 (BC009272) | Unknown (protein for MGC:10273) [Homo sapiens] | 622 | 581/605 (96) | 585/605 (96) | 0.0 |

This BLASTP data is displayed graphically in the ClustalW in Table 2E. A multiple sequence alignment is given in Table 2E, with the SEC2 protein being shown on line 1, in a ClustalW analysis comparing the protein of the invention with the related protein sequences shown in Table 2D.

TABLE 2E

ClustalW Alignment of SEC2

```
1) SEC2          (SEQ ID NO:4)
2) gi|7108356|   (SEQ ID NO:46)
3) gi|13751645|  (SEQ ID NO:47)
4) gi|5031917|   (SEQ ID NO:48)
5) gi|14336721|  (SEQ ID NO:49)
6) gi|14424505|  (SEQ ID NO:50)

10        20        30        40        50
                ....|....|....|....|....|....|....|....|....|....|
SEC2            MALQRLDPCW-SCGD-RPGSLLFLLFSLGWVHEARTLAGETGTESAPLGG
gi|7108356|     MALQRLDPCW-SCGD-RPGSLLFLLFSLGWVHEARTLAGETGTESAPLGG
gi|13751645|    MALPTARPLLGSCGTPALGSLLFLLFSLGWVQPSRTLAGETGQEAAPLDG
gi|5031917|     MALPTARPLLGSCGTPALGSLLFLLFSLGWVQPSRTLAGETGQEAAPLDG
gi|14336721|    MALPTARPLLGSCGTPALGSLLFLLFSLGWVQPSRTLAGETGQEAAPLDG
gi|14424505|    MALPTARPLLGSCGTPALGSLLFLLFSLGWVQPSRTLAGETGQEAAPLDG
```

TABLE 2E-continued

ClustalW Alignment of SEC2

```
                      60         70         80         90        100
              ....|....|....|....|....|....|....|....|....|....|
SEC2          VLTTPHNISSLSPRQLLGFPCAEVSGLSTERVRELAVALAQKNVKLSTEQ
gi|7108356|   VLTTPHNISSLSPRQLLGFPCAEVSGLSTERVRELAVALAQKNVKLSTEQ
gi|13751645|  VLANPPNISSLSPRQLLGFPCAEVSGLSTERVRELAVALAQKNVKLSTEQ
gi|5031917|   VLANPPNISSLSPRQLLGFPCAEVSGLSTERVRELAVALAQKNVKLSTEQ
gi|14336721|  VLANPPNISSLSPRQLLGFPCAEVSGLSTERVRELAVALAQKNVKLSTEQ
gi|14424505|  VLANPPNISSLSPRQLLGFPCAEVSGLSTERVRELAVALAQKNVKLSTEQ 110        120        130        140        150
              ....|....|....|....|....|....|....|....|....|....|
SEC2          LRCLAHRLSEPPEDLDALPLDLLLFLNPDAFSGPQACTRFFSRITKANVD
gi|7108356|   VLANPPNISSLSPRQLLGFPCAEVSGLSTERVRELAVALAQKNVKLSTEQ
gi|13751645|  VLANPPNISSLSPRQLLGFPCAEVSGLSTERVRELAVALAQKNVKLSTEQ
gi|5031917|   VLANPPNISSLSPRQLLGFPCAEVSGLSTERVRELAVALAQKNVKLSTEQ
gi|14336721|  VLANPPNISSLSPRQLLGFPCAEVSGLSTERVRELAVALAQKNVKLSTEQ
gi|14424505|  VLANPPNISSLSPRQLLGFPCAEVSGLSTERVRELAVALAQKNVKLSTEQ 160        170        180        190        200
              ....|....|....|....|....|....|....|....|....|....|
SEC2          LLPRGAPERQRLLPAALACWGVRGSLLSEADVRALGGLACDLPGRFVAES
gi|7108356|   LLPRGAPERQRLLPAALACWGVRGSLLSEADVRALGGLACDLPGRFVAES
gi|13751645|  LLPRGAPERQRLLPAALACWGVRGSLLSEADVRALGGLACDLPGRFVAES
gi|5031917|   LLPRGAPERQRLLPAALACWGVRGSLLSEADVRALGGLACDLPGRFVAES
gi|14336721|  LLPRGAPERQRLLPAALACWGVRGSLLSEADVRALGGLACDLPGRFVAES
gi|14424505|  LLPRGAPERQRLLPAALACWGVRGSLLSEADVRALGGLACDLPGRFVAES 210        220        230        240        250
              ....|....|....|....|....|....|....|....|....|....|
SEC2          AEVLLPRLVSCPGPLDQDQQEAARAALQGGGPPYGPPSTWSVSTMDALRG
gi|7108356|   AEVLLPRLVSCPGPLDQDQQEAARAALQGGGPPYGPPSTWSVSTMDALRG
gi|13751645|  AEVLLPRLVSCPGPLDQDQQEAARAALQGGGPPYGPPSTWSVSTMDALRG
gi|5031917|   AEVLLPRLVSCPGPLDQDQQEAARAALQGGGPPYGPPSTWSVSTMDALRG
gi|14336721|  AEVLLPRLVSCPGPLDQDQQEAARAALQGGGPPYGPPSTWSVSTMDALRG
gi|14424505|  AEVLLPRLVSCPGPLDQDQQEAARAALQGGGPPYGPPSTWSVSTMDALRG 260        270        280        290        300
              ....|....|....|....|....|....|....|....|....|....|
SEC2          LLPVLGQPIIRSIPQGIVAAWRQRSSRDPSWRQPERTILRPRFRREVEKT
gi|7108356|   LLPVLGQPIIRSIPQGIVAAWRQRSSRDPSWRQPERTILRPRFRREVEKT
gi|13751645|  LLPVLGQPIIRSIPQGIVAAWRQRSSRDPSWRQPERTILRPRFRREVEKT
gi|5031917|   LLPVLGQPIIRSIPQGIVAAWRQRSSRDPSWRQPERTILRPRFRREVEKT
gi|14336721|  LLPVLGQPIIRSIPQGIVAAWRQRSSRDPSWRQPERTILRPRFRREVEKT
gi|14424505|  LLPVLGQPIIRSIPQGIVAAWRQRSSRDPSWRQPERTILRPRFRREVEKT 310        320        330        340        350
              ....|....|....|....|....|....|....|....|....|....|
SEC2          ACPSGKKAREIDESLIFYKKWELEACVDAALLATQMDRVNAIPFTYEQLD
gi|7108356|   ACPSGKKAREIDESLIFYKKWELEACVDAALLATQMDRVNAIPFTYEQLD
gi|13751645|  ACPSGKKAREIDESLIFYKKWELEACVDAALLATQMDRVNAIPFTYEQLD
gi|5031917|   ACPSGKKAREIDESLIFYKKWELEACVDAALLATQMDRVNAIPFTYEQLD
gi|14336721|  ACPSGKKAREIDESLIFYKKWELEACVDAALLATQMDRVNAIPFTYEQLD
gi|14424505|  ACPSGKKAPEIDESLIFYKKWELEACVDAALLATQMDRVNAIPFTYEQLD 360        370        380        390        400
              ....|....|....|....|....|....|....|....|....|....|
SEC2          VLKHKLDELYPQGYPESVIQHLGYLFLKMSPEDIRKWNVTSLETLKALLE
gi|7108356|   VLKHKLDELYPQGYPESVIQHLGYLFLKMSPEDIRKWNVTSLETLKALLE
gi|13751645|  VLKHKLDELYPQGYPESVIQHLGYLFLKMSPEDIRKWNVTSLETLKALLE
gi|5031917|   VLKHKLDELYPQGYPESVIQHLGYLFLKMSPEDIRKWNVTSLETLKALLE
gi|14336721|  VLKHKLDELYPQGYPESVIQHLGYLFLKMSPEDIRKWNVTSLETLKALLE
gi|14424505|  VLKHKLDELYPQGYPESVIQHLGYLFLKMSPEDIRKWNVTSLETLKALLE 410        420        430        440        450
              ....|....|....|....|....|....|....|....|....|....|
SEC2          VDKGHEMSPQAPRRPLPQVATLIDRFVKGRGQLDKDTLDTLTAFYPGYLC
gi|7108356|   VDKGHEMSPQAPRRPLPQVATLIDRFVKGRGQLDKDTLDTLTAFYPGYLC
gi|13751645|  VNKGHEMSPQAPRRPLPQVATLIDRFVKGRGQLDKDTLDTLTAFYPGYLC
gi|5031917|   VNKGHEMS--------PQVATLIDRFVKGRGQLDKDTLDTLTAFYPGYLC
gi|14336721|  VNKGHEMS--------PQVATLIDRFVKGRGQLDKDTLDTLTAFYPGYLC
gi|14424505|  VNKGHEMS--------PQVATLIDRFVKGRGQLDKDTLDTLTAFYPGYLC 460        470        480        490        500
              ....|....|....|....|....|....|....|....|....|....|
SEC2          SLSPEELSSVPPSSIWAVRPQDLDTCDPRQLDVLYPKARLAFQNMNGSEY
gi|7108356|   SLSPEELSSVPPSSIWAVRPQDLDTCDPRQLDVLYPKARLAFQNMNGSEY
gi|13751645|  SLSPEELSSVPPSSIWAVRPQDLDTCDPRQLDVLYPKARLAFQNMNGSEY
gi|5031917|   SLSPEELSSVPPSSIWAVRPQDLDTCDPRQLDVLYPKARLAFQNMNGSEY
gi|14336721|  SLSPEELSSVPPSSIWAVRPQDLDTCDPRQLDVLYPKARLAFQNMNGSEY
gi|14424505|  SLSPEELSSVPPSSIWAVRPQDLDTCDPRQLDVLYPKARLAFQNMNGSEY
```

TABLE 2E-continued

ClustalW Alignment of SEC2

```
                510       520       530       540       550
           ....|....|....|....|....|....|....|....|....|....|
SEC2       FVKIQSFLGGAPTEDLKALSQQNVSMDLATFMKLRTDAVLPLTVAEVQKL
gi|7108356| FVKIQSFLGGAPTEDLKALSQQNVSMDLATFMKLRTDAVLPLTVAEVQKL
gi|13751645| FVKIQSFLGGAPTEDLKALSQQNVSMDLATFMKLRTDAVLPLTVAEVQKL
gi|5031917| FVKIQSFLGGAPTEDLKALSQQNVSMDLATFMKLRTDAVLPLTVAEVQKL
gi|14336721| FVKIQSFLGGAPTEDLKALSQQNVSMDLATFMKLRTDAVLPLTVAEVQKL
gi|14424505| FVKIQSFLGGAPTEDLKALSQQNVSMDLATFMKLRTDAVLPLTVAEVQKL 560       570       580       590       600
           ....|....|....|....|....|....|....|....|....|....|
SEC2       LGPHVEGLKAEERHRPVRDWILRQRQDDLDRLGLGLQGGIPNGYLVLDLS
gi|7108356| LGPHVEGLKAEERHRPVRDWILRQRQDDLDRLGLGLQGGIPNGYLVLDLS
gi|13751645| LGPHVEGLKAEERHRPVRDWILRQRQDDLDRLGLGLQGGIPNGYLVLDLS
gi|5031917| LGPHVEGLKAEERHRPVRDWILRQRQDDLDRLGLGLQGGIPNGYLVLDLS
gi|14336721| LGPHVEGLKAEERHRPVRDWILRQRQDDLDRLGLGLQGGIPNGYLVLDLS
gi|14424505| LGPHVEGLKAEERHRPVRDWILRQRQDDLDRLGLGLQGGIPNGYLVLDLS 610       620       630
           ....|....|....|....|....|....|
SEC2       VQEILSGTPCLLGPGPVLTVLALLLASTLA
gi|7108356| VQEILSGTPCLLGPGPVLTVLALLLASTLA
gi|13751645| MQEALSGTPCLLGPGPVLTVLALLLASTLA
gi|5031917| MQEALSGTPCLLGPGPVLTVLALLLASTLA
gi|14336721| MQEALSGTPCLLGPGPVLTVLALLLASTLA
gi|14424505| MQEALSGTPCLLGPGPVLTVLALLLASTLA
```

Mesothelin, a cell-surface differentiation antigen, is a 40-kD GPI-linked (glycosylphosphatidylinositol) cell-surface glycoprotein, that is present on the surface of normal mesothelium and is overexpressed in many patients with cancer and malignant mesotheliomas. For example, mesothelin is a marker for pancreatic adenocarcinoma, ovarian cancer, pancreatic cancer, lung cancer, squamous cell carcinoma, and numerous other neoplastic cellular transformations as identified by gene expression analysis. Mesothelin overexpression in cancers has potential diagnostic, imaging, and therapeutic implications. Mesothelin is a antigen that is expressed in a highly tissue-specific manner. High level expression of the protein is seen in the mesothelium, and the tissue forming the pleural, pericardial, and peritoneal membranes. The gene contains an 1884-bp open reading frame encoded by 15 exons occupying 8 kb of human chromosome 16. An 1850-bp region of genomic DNA at the 5' end of the gene encompassing the proposed transcriptional start site was also cloned. This region lacks a TATA box and other regulatory elements such as SP1 sites, which are commonly found in promoters. Transient transfection analyses demonstrated that mesothelium-specific control elements are present within the 1.85-kb region. Minimal constitutive promoter elements were localized to a 317-bp region. Tissue-specific enhancer elements upstream of the minimal promoter were found to activate transcription from the homologous and a heterologous promoter in a position- and orientation-independent manner.

The SEC2 disclosed in this invention is expressed in at least the following tissues: apical microvilli of the retinal pigment epithelium, arterial (aortic), basal forebrain, brain, Burkitt lymphoma cell lines, corpus callosum, cardiac (atria and ventricle), caudate nucleus, CNS and peripheral tissue, cerebellum, cerebral cortex, colon, cortical neurogenic cells, endothelial (coronary artery and umbilical vein) cells, palate epithelia, eye, neonatal eye, frontal cortex, fetal hematopoietic cells, heart, hippocampus, hypothalamus, leukocytes, liver, fetal liver, lung, lung lymphoma cell lines, fetal lymphoid tissue, adult lymphoid tissue, those that express MHC I, II, and III, nervous tissues, medulla, subthalamic nucleus, ovary, pancreas, pituitary, placenta, pons, prostate, putamen, serum, skeletal muscle, small intestine, smooth muscle (coronary artery in aortia) spinal cord, spleen, stomach, taste receptor cells of the tongue, testis, thalamus, and thymus tissue. This information was derived by determining the tissue sources of the sequences that were included in the invention including but not limited to Seq-Calling sources, public EST sources, literature sources, and/or RACE sources. Further expression data for SEC2 is provided in Example 2.

The nucleic acids and proteins of SEC2 are useful in potential therapeutic applications implicated in various SEC-related pathological disorders described further herein. The SEC2 nucleic acid encoding the mesothelin-like protein of the invention, or fragments thereof, may further be useful in diagnostic applications, wherein the presence or amount of the nucleic acid or the protein are to be assessed.

These materials are further useful in the generation of antibodies that bind immunospecifically to the substances of the invention for use in therapeutic or diagnostic methods. These antibodies may be generated according to methods known in the art, using prediction from hydrophobicity charts, as described in the "Anti-SECX Antibodies" section below. The disclosed SEC2 protein has multiple hydrophilic regions, each of which can be used as an immunogen. In one embodiment, for example, a contemplated SEC2 epitope comprises from about amino acids 5 to about 105. In another embodiment, for example, a SEC2 epitope comprises from about amino acids 120 to about 180. In further embodiments, for example, a SEC2 epitope comprises from about 210 to about 230, from about 260 to about 310, from about 320 to about 420, from about 450 to about 520, and about 550 to about 600.

SEC3

The disclosed SEC3 (alternatively referred to herein as CG56015-01) includes the 852 nucleotide sequence (SEQ ID NO:5) shown in Table 3A. A SEC3 ORF begins with a Kozak consensus ATG initiation codon at nucleotides 131–133 and ends with a TGT codon at nucleotides 471–473. A putative untranslated region upstream from the initiation codon is underlined in Table 3A, and the start and stop codons are in bold letters.

TABLE 3A

SEC3 Nucleotide Sequence

CTTCCTAGCTCCTCTCCTCCAGGGCCAGACTGAGCCCAGGTTGATTTCAGGCGGACACCA (SEQ ID NO:5)

ATAGACTCCACAGCAGCTCCAGGAGCCCAGACACCGGCGGCCAGAAGCAAGGCTAGGAGC

TGCTGCAGCCATGTCGGCCCTCAGCCTCCTCATTCTGGGCCTGCTCACGGCAGTGCCACC

TGCCAGCTGTCAGCAAGGCCTGGGGAACCTTCAGCCCTGGATGCAGGGCCTTATCGCGGT

GGCCGTGTTCCTGGTCCTCGTTGCAATCGCCTTTGCAGTCAACCACTTCTGGTGCCAGGA

GGAGCCGGAGCCTGCACACATGATCCTGACCGTCGGAAACAAGGCAGATGGAGTCCTGGT

GGGAACAGATGGAAGGTACTCTTCGATGGCGGCCAGTTTCAGGTCCAGTGAGCATGAGAA

TGCCTATGAGAATGTGCCCGAGGAGGAAGGCAAGGTCCGCAGCACCCCGATGTAACCTTC

TCTGTGGCTCCAACCCCAAGACTCCCAGGCACATGGGATGGATGTCCAGTGCTACCACCC

AAGCCCCCTCCTTCTTTGTGTGGAATCTGCAATAGTGGGCTGACTCCCTCCAGCCCCATG

CCGGCCCTACCCGCCCTTGAAGTATAGCCAGCCAAGGTTGGAGCTCAGACCGTGTCTAGG

TTGGGGCTCGGCTGTGGCCCTGGGGTCTCCTGCTCAGCTCAGAAGAGCCTTCTGGAGAGG

ACAGTCAGCTGAGCACCTCCCATCCTGCTCACACGTCCTTCCCCATAACTATGGAAATGG

CCCTAATTTCTGTGAAATAAAGACTTTTTGTATTTCTGGGGCTGAGGCTCAGCAACAGCC

CCTCAGGCTTCC

The SEC3 polypeptide (SEQ ID NO:6) encoded by SEQ ID NO:5 is 114 amino acids in length and is presented using the one-letter amino acid code in Table 3B. The Psort profile for SEC3 predicts that this sequence has a signal peptide and is likely to be localized at the plasma membrane with a certainty of 0.4600. In alternative embodiments, a SEC3 polypeptide is located to endoplasmic reticulum (membrane) with a certainty of 0.1000, or to the endoplasmic reticulum (lumen) with a certainty of 0.1000: The Signal P predicts a likely cleavage site for a SEC3 peptide is between positions 49 and 50, i.e., at the dash in the sequence AFA-VN.

TABLE 3B

SEC3 protein sequence

MSALSLLILGLLTAVPPASCQQGLGNLQPWMQGLIAVAVFLVLVAIAFAVNHFWCQEEPE (SEQ ID NO:6)

PAHMILTVGNKADGVLVGTDGRYSSMAASFRSSEHENAYENVPEEEGKVRSTPM

A BLAST analysis of SEC3 was run against the proprietary PatP GENESEQ Protein Patent database. It was found, for example, that the amino acid sequence of SEC3 had high homology to other proteins as shown in Table 3C.

TABLE 3C

BLASTX results from PatP database for SEC3

| Sequences producing High-scoring Segment Pairs: | High Score | Smallest Sum Probability P(N) |
|---|---|---|
| patp: AAG00220 Human secreted protein | 394 | 2.2e−36 |
| patp: AAY13947 Human transmembrane protein, HP10495 | 92 | 0.00022 |

TABLE 3C-continued

BLASTX results from PatP database for SEC3

| Sequences producing High-scoring Segment Pairs: | High Score | Smallest Sum Probability P(N) |
|---|---|---|
| patp: AAY07878 Human secreted protein fragment | 92 | 0.00022 |
| patp: AAY11997 Human 5' EST secreted protein | 92 | 0.00022 |

TABLE 3C-continued

BLASTX results from PatP database for SEC3

| Sequences producing High-scoring Segment Pairs: | High Score | Smallest Sum Probability P(N) |
|---|---|---|
| patp: AAG73549 Human colon cancer antigen protein | 72 | 0.067 |

In a search of public sequence databases, it was found, for example, that the amino acid sequence of the SEC3 protein of the present invention was found to have 114 of 114 amino acid residues (100%) identical to the 104 amino acid NM_005764. SEC3 also has homology to the other proteins shown in the BLASTP data in Table 3D.

TABLE 3D

SEC3 BLASTP results

| Gene Index/Identifier | Protein/Organism | Length (aa) | Identity (%) | Positive (%) | Expect |
|---|---|---|---|---|---|
| gi\|5031657\|ref\|NP_005755.1\| (NM_005764) | epithelial protein up-regulated in carcinoma, membrane associate [Homo sapiens] | 114 | 114/114 (100) | 114/114 (100) | 6e−53 |
| gi\|15126763\|gb\|AAH12303.1\| AAH12303 (BC012303) | Similar to epithelial protein up-regulated in carcinoma, membrane associated protein 17 [Homo sapiens] | 114 | 112/114 (98) | 112/114 (98) | 1e−51 |
| gi\|13385522\|ref\|NP_080294.1\| (NM_026018) | RIKEN cDNA 2700030M23 gene [Mus musculus] | 114 | 94/114 (82) | 101/114 (88) | 2e−48 |
| gi\|15278177\|gb\|AAK94063.1\| AF402772_1 (AF402772) | membrane-associated protein MAP17 [Rattus norvegicus] | 114 | 94/114 (82) | 100/114 (87) | 2e−42 |
| gi\|6561276\|gb\|AAF16875.1\| (AF110026) | DD96 homolog [Rattus norvegicus] | 78 | 43/53 (81) | 43/53 (81) | 2e−09 |

This BLASTP data is displayed graphically in the ClustalW in Table 3E. A multiple sequence alignment is given in Table 3E, with the SEC3 protein being shown on line 1, in a ClustalW analysis comparing the protein of the invention with the related protein sequences shown in Table 3D.

TABLE 3E

ClustalW Alignment of SEC3

```
1) SEC3        (SEQ ID NO:6)
2) gi|5031657| (SEQ ID NO:51)
3) gi|15126763|(SEQ ID NO:52)
4) gi|13385522|(SEQ ID NO:53)
5) gi|15278177|(SEQ ID NO:54)
6) gi|6561276| (SEQ ID NO:55)

10        20        30        40        50
                ....|....|....|....|....|....|....|....|....|....|
SEC3            --------------------------MSALSLLILGLLTAVPPASCQQGLG
gi|5031657|     --------------------------MSALSLLILGLLTAVPPASCQQGLG
gi|15126763|    --------------------------MSALSLLILGLLMAVPPASCQQGLG
gi|13385522|    --------------------------MLAFSLLVLGLLAEVAPASCQQGLG
gi|15278177|    --------------------------MLALSLLALGLLAEVAPASCQQGLG
gi|6561276|     ISYKHSRPPAAPGVKTPAVLQLPAAMLALILIALGLLAEVAPASCLQGLG 60        70        80        90       100
                ....|....|....|....|....|....|....|....|....|....|
SEC3            NLQPWMQGLIAVAVFLVLVAIAFAVNHFWCQEEPEPAHMILTVGNKADGV
gi|5031657|     NLQPWMQGLIAVAVFLVLVAIAFAVNHFWCQEEPEPAHMILTVGNKADGV
gi|15126763|    NLQPWMQGLIAVAVFLVLVAIAFAVKHFWCQEEPEPAHMILTVGNKADGV
gi|13385522|    NLQPWMQGLIAVAVFLVLVAIVFAVNHFWCQEEPEPGSTVMIIGNKADGV
gi|15278177|    NLQPWMQGLIAVAVFLVLVAIAFAVNHFWCQEEQEPGSTMMITGNKADGV
gi|6561276|     NLQPWMLGLIAVAVFLVLVAIAFPVNRF----------------------

110       120       130
                ....|....|....|....|....|....|....
SEC3            LVGTDGRYSSMAASFRSSEHENAYENVPEEEGKVRSTPM
gi|5031657|     LVGTDGRYSSMAASFRSSEHENAYENVPEEEGKVRSTPM
gi|15126763|    LVGTDGRYSSMAASFRSSEHENAYENVPEEEGKVRSTPM
gi|13385522|    LVGMDGRYSSMASGFRSSEHKNAYENVLEEEGRVRSTPM
gi|15278177|    LVGMDGRYSSMASGFRSSEHKNAFENVLEEEGRVRSTPM
gi|6561276|     ---------------------------------------
```

MAP17 and PDZK1 mRNAs are markedly up-regulated in human carcinomas. The MAP17 protein product is a 17-kd membrane-associated protein as determined by immunoprecipitation. MAP17 is expressed at significant levels in a the proximal tubular epithelial cells of the kidney, and is induced in immortalized breast ductal epithelial cell lines compared with normal breast ductal epithelial cells, and, in vivo, in premalignant conditions, such as adenoma of the colon and ductal carcinoma in situ of the breast. MAP17 is expressed abundantly in carcinomas arising from kidney, colon, lung, and breast, in some cases with a membrane-associated apical glandular distribution. In tissue culture, MAP17 was localized to the cell membrane in areas of cell-cell contact, i.e., the distribution of cell-function-associated proteins. Transfection of a full-length wild-type MAP17 cDNA clone into a colon carcinoma cell line, HT-29, markedly decreased cell proliferation in vitro and tumor growth in vivo. MAP17 plays a role in the early events associated with malignant transformation, and modulation of MAP17 expression and activation thus provides for a method of treating the above mentioned diseases.

The MAP17 disclosed herein as SEC3 in this invention is expressed in at least the following tissues: apical microvilli of the retinal pigment epithelium, arterial (aortic), basal forebrain, brain, Burkitt lymphoma cell lines, corpus callosum, cardiac (atria and ventricle), caudate nucleus, CNS and peripheral tissue, cerebellum, cerebral cortex, colon, cortical neurogenic cells, endothelial (coronary artery and umbilical vein) cells, palate epithelia, eye, neonatal eye, frontal cortex, fetal hematopoietic cells, heart, hippocampus, hypothalamus, leukocytes, liver, fetal liver, lung, lung lymphoma cell lines, fetal lymphoid tissue, adult lymphoid tissue, those that express MHC I, II, and III, nervous tissues, medulla, subthalamic nucleus, ovary, pancreas, pituitary, placenta, pons, prostate, putamen, serum, skeletal muscle, small intestine, smooth muscle (coronary artery in aortia) spinal cord, spleen, stomach, taste receptor cells of the tongue, testis, thalamus, and thymus tissue. This information was derived by determining the tissue sources of the sequences that were included in the invention including but not limited to SeqCalling sources, public EST sources, literature sources, and/or RACE sources. Further expression data for SEC3 is provided in Example 2.

charts, as described in the "Anti-SECX Antibodies" section below. The disclosed SEC3 protein has multiple hydrophilic regions, each of which can be used as an immunogen. In one embodiment, for example, a contemplated SEC3 epitope comprises from about amino acids 20 to about 28. In another embodiment, for example, a SEC3 epitope comprises from about amino acids 55 to about 65. In further embodiments, for example, a SEC3 epitope comprises from about 70 to about 80, and from about 82 to about 114.

SEC4

The disclosed SEC4 (alternatively referred to herein as CG55023-01) includes the 527 nucleotide sequence (SEQ ID NO:7) shown in Table 4A. A SEC4 ORF begins with a Kozak consensus ATG initiation codon at nucleotides 59–61 and ends with a TGT codon at nucleotides 509–511. A putative untranslated region upstream from the initiation codon is underlined in Table 4A, and the start and stop codons are in bold letters. The disclosed SEC4 maps to chromosome 20.

TABLE 4A

SEC4 NUCLEOTIDE SEQUENCE

CCGTCAGTCTAGAAGGATAAGAGAAAGAAAGTTAAGCAACTACAGGAAATGGCTTTGGGA (SEQ ID NO:7)

GTTCCAATATCAGTCTATCTTTTATTCAACGCAATGACAGCACTGACCGAAGAGGCAGCC

GTGACTGTAACACCTCCAATCACAGCCCAGCAAGGTAACTGGACAGTTAACAAAACAGAA

GCTCACAACATAGAAGGACCCATAGCCTTGAAGTTCTCACACCTTTGCCTGGAAGATCAT

AACAGTTACTGCATCAACGGTGCTTGTGCATTCCACCATGAGCTAGAGAAAGCCATCTGC

AGGTGTTTTACTGGTTATACTGGAGAAAGGTGTGAGCACTTGACTTTAACTTCATATGCT

GTGGATTCTTATGAAAAATACATTGCAATTGGGATTGGTGTTGGATTACTATTAAGTGGT

TTTCTTGTTATTTTTTACTGCTATATAAGAAAGAGGTGTCTAAAATTGAAATCGCCTTAC

AATGTCTGTTCTGGAGAAAGACGACCACTGTGAGGCCTTTGTGAAGA

The nucleic acids and proteins of SEC3 are useful in potential therapeutic applications implicated in various SEC-related pathological disorders described further herein. The SEC3 nucleic acid encoding the MAP17-like protein of the invention, or fragments thereof, may further be useful in diagnostic applications, wherein the presence or amount of the nucleic acid or the protein are to be assessed.

These materials are further useful in the generation of antibodies that bind immunospecifically to the substances of the invention for use in therapeutic or diagnostic methods. These antibodies may be generated according to methods known in the art, using prediction from hydrophobicity The SEC4 polypeptide (SEQ ID NO:8) encoded by SEQ ID NO:7 is 154 amino acids in length and is presented using the one-letter amino acid code in Table 4B. The Psort profile for SEC4 predicts that this sequence has a signal peptide and is likely to be localized at the plasma membrane with a certainty of 0.4960. In alternative embodiments, a SEC4 polypeptide is located to the Golgi body with a certainty of 0.1900, to the endoplasmic reticulum (membrane) with a certainty of 0.6400, or to the endoplasmic reticulum (lumen) with a certainty of 0.1000. The Signal P predicts a likely cleavage site for a SEC4 peptide is between positions 20 and 21, i.e., at the dash in the sequence ALT-EE.

TABLE 4B

SEC4 PROTEIN SEQUENCE

MALGVPISVYLLFNAMTALTEEAAVTVTPPITAQQGNWTVNKTEAHNIEGPIALKFSHLC (SEQ ID NO:8)

LEDHNSYCINGACAFHHELEKAICRCFTGYTGERCEHLTLTSYAVDSYEKYIAIGIGVGL

LLSGFLVIFYCYIRKRCLKLKSPYNVCSGERRPL

A BLAST analysis of SEC4 was run against the proprietary PatP GENESEQ Protein Patent database. It was found, for example, that the amino acid sequence of SEC4 had high homology to other proteins as shown in Table 4C.

TABLE 4C

BLASTX results from PatP database for SEC4

| Sequences producing High-scoring Segment Pairs: | High Score | Smallest Sum Probability P(N) |
|---|---|---|
| patp: AAY76018 Human TGF-alpha homologue huTR1 | 828 | 2.2e−82 |
| patp: AAB55957 Skin cell protein | 828 | 2.2e−82 |
| patp: AAE06704 Human transforming growth factor (TGF) alpha | 828 | 2.2e−82 |
| patp: AAY94620 Epidermal growth factor-like variant | 819 | 2.0e−81 |

TABLE 4C-continued

BLASTX results from PatP database for SEC4

| Sequences producing High-scoring Segment Pairs: | High Score | Smallest Sum Probability P(N) |
|---|---|---|
| patp: AAY76009 Murine TGF-alpha homologue muTR1 | 629 | 2.8e−61 |

In a search of public sequence databases, it was found, for example, that the amino acid sequence of the SEC4 protein of the present invention was found to have 129 of 139 amino acid residues (92%) identical to the 159 amino acid XM_068181. SEC4 also has homology to the other proteins shown in the BLASTP data in Table 4D.

TABLE 4D

SEC4 BLASTP results

| Gene Index/Identifier | Protein/Organism | Length (aa) | Identity (%) | Positive (%) | Expect |
|---|---|---|---|---|---|
| gi|17437836|ref XP_068181.1| (XM_068181) | similar to Epigen protein (*H. sapiens*) [*Homo sapiens*] | 159 | 129/139 (92) | 129/139 (92) | 3e−66 |
| gi|16716373|ref NP_444317.1| (NM_053087) | epithelial mitogen; RIKEN cDNA 2310069M11 gene [*Mus musculus*] | 152 | 119/150 (79) | 129/150 (85) | 1e−59 |
| gi|7799191|emb |CAB90827.1| (AJ400622) | tomoregulin-1 [*Mus musculus*] | 354 | 32/87 (36) | 48/87 (54) | 7e−07 |
| gi|12711686|ref |NP_075409.1| (NM_023020) | transmembrane protein with EGF-like and two follistatin-like domains 1 [*Rattus norvegicus*] | 373 | 32/87 (36) | 48/87 (54) | 8e−07 |
| gi|13641855|ref XP_005346.3| (XM_005346) | similar to transmembrane protein with EGF-like and two follistatin-like domains 1; chromosome 9 open reading frame 2 (*H. sapiens*) [*Homo sapiens*] | 53 | 30/83 (36) | 45/83 (54) | 1e−06 |

This BLASTP data is displayed graphically in the ClustalW in Table 4E. A multiple sequence alignment is given in Table 4E, with the SEC4 protein being shown on line 1, in a ClustalW analysis comparing the protein of the invention with the related protein sequences shown in Table 4D.

TABLE 4E

ClustalW Alignment of SEC4

```
1) SEC4          (SEQ ID NO:8)
2) gi|17437836|  (SEQ ID NO:56)
3) gi|16716373|  (SEQ ID NO:57)
4) gi|7799191|   (SEQ ID NO:58)
5) gi|12711686|  (SEQ ID NO:59)
6) gi|13641855|  (SEQ ID NO:60)
```

TABLE 4E-continued

ClustalW Alignment of SEC4

```
                 10        20        30        40        50
            ....|....|....|....|....|....|....|....|....|....|
SEC4        --------------------------------------------------
gi|17437836| --------------------------------------------------
gi|16716373| --------------------------------------------------
gi|7799191|  ----------------------YPQDSARVAFCLPGSRASNQPAGGGG--
gi|12711686| MG---AQAPLRLPAAPPLAVCGYTSVLLLFAFCLPGSGASNQPAGGGG--
gi|13641855| MGAAAAEAPLRLPAAPPLAFCCYTSVLLLFAFSLPGSRASNQPPGGGGGS 60        70        80        90       100
            ....|....|....|....|....|....|....|....|....|....|
SEC4        --------------------------------------------------
gi|17437836| --------------------------------------------------
gi|16716373| --------------------------------------------------
gi|7799191|  --DCPGGRGKS-NCSELNLRESDIRVCDESSCKYGGVCKEDGDGLKCACQ
gi|12711686| --DCPGGRGKSINCSELNLRESDIRACDESSCKYGGVCKEDGDGLKCACQ
gi|13641855| GGDCPGGKGKSINCSELNVRESDVRVCDESSCKYGGVCKEDGDGLKCACQ 110       120       130       140       150
            ....|....|....|....|....|....|....|....|....|....|
SEC4        --------------------------------------------------
gi|17437836| --------------------------------------------------
gi|16716373| --------------------------------------------------
gi|7799191|  FQCHTNYIPVCGSNGDTYQNECFLRRAACKHQKDITVVARGPCYSDNGSG
gi|12711686| FQCHTNYIPVCGSNGDTYQNECFLRRAACKHQKDITVVARGPCYSDNGSG
gi|13641855| FQCHTNYIPVCGSNGDTYQNECFLRRAACKHQKEITVIARGPCYSDNGSG 160       170       180       190       200
            ....|....|....|....|....|....|....|....|....|....|
SEC4        --------------------------------------------------
gi|17437836| --------------------------------------------------
gi|16716373| --------------------------------------------------
gi|7799191|  SGEGAEEEGSGAGAHRKHSKCGPCKYKAECDEDAENVGCVCNIDCSGYSF
gi|12711686| SGEG-EEEGSGAGAHRKHSKCGPCKYKAECDEDAENVGCVCNIDCSGYSF
gi|13641855| SGEG-EEEGSGAEVHRKHSKCGPCKYKAECDEDAENVGCVCNIDCSGYSF 210       220       230       240       250
            ....|....|....|....|....|....|....|....|....|....|
SEC4        ----MALGVPISVYLLFNAMT-ALTEEAAVTVTPPITAQQGN--------
gi|17437836| --------------------MT-ALTEEAAVTVTPPITAQQ---------
gi|16716373| ----MALGVLIAVCLLFKAMKAALSEEAEV--IPPSTAQQSN--------
gi|7799191|  NPVCASDGSSYNNPCFVREADCIKQEQIDIRHLGHCTDTDDVSSLGKKDP
gi|12711686| NPVCASDGSSYNNPCFVREASCIRQEQIDIRHLGHCTDTDDTSLLGKKDD
gi|13641855| NPVCASDGSSYNNPCFVREASCIKQEQIDIRHLGHCTDTDDTSLLGKKDD 260       270       280       290       300
            ....|....|....|....|....|....|....|....|....|....|
SEC4        ---WTVNKTEAHNIEGPIALKFSHLCLEDHNSYCINGACAFHHELEKAIC
gi|17437836| ------AD-----NIEGPIALKFSHLCLEDHNSYCINGACAFHHELEKAIC
gi|16716373| ---WTFNNTEADYIEEPVALKFSHPCLEDHNSYCINGACAFHHELKQAIC
gi|7799191|  GLLYRPDVKDAGDEREDVYIGSHMPCPENLNGYCIHGKCEFIYSTQKASC
gi|12711686| GLQYRPDVKDAGDQREDVYIGSHMPCPENLNGYCIHGKCEFIYSTQKASC
gi|13641855| GLQYRPDVKDASDQREDVYIGNHMPCPENLNGYCIHGKCEFIYSTQKASC 310       320       330       340       350
            ....|....|....|....|....|....|....|....|....|....|
SEC4        RCFTGYTGERCEHLTLTS-YAVDSYEKYIAIGIG--VGLLLSGFLVIFYC
gi|17437836| RCFTGYTGERCEHLTLTS-YAVDSYEKYIAIGIG--VGLLLSGFLVIFYC
gi|16716373| RCFTGYTGQRCEHLTLTS-YAVDSYEKYIAIGIG--VGLLISAFLAVFYC
gi|7799191|  RCESGYTGQHCEKTDFSILYVVPSRQKLTHVLIAAIIGAVQIAIIVAIVM
gi|12711686| RCESGYTGQHCEKTDFSILYVVPSRQKLTHVLIAAIIGAVQIAIIVAIVM
gi|13641855| RCESGYTGQHCEKTDFSILYVVPSRQKLTHVLIAAIIGAVQIAIIVAIVM 360       370       380       390       400
            ....|....|....|....|....|....|....|....|....|....|
SEC4        YIRKRCLKLKSPYNVCSGERRPL---------------------------
gi|17437836| YIRKRCLKLKSPYNVCSGERRPLYQWNYLVTIHLDRNPGSLLLNKSLQLA
gi|16716373| YIRKRCINLKSPYIICSG-GSPL---------------------------
gi|7799191|  CITRKCPKNNRGRRQKQNLGHFTSDTSSKMV-------------------
gi|12711686| CITRKCPKNNRGRRQKQNLGHFTSETSSRMV-------------------
gi|13641855| CITRKCPKNNRGRRQKQNLGHFTSDTSSRMV-------------------

..
SEC4        --
gi|17437836| LK
gi|16716373| --
gi|7799191|  --
gi|12711686| --
gi|13641855| --
```

The biological effects of epidermal growth factor (EGF) and transforming growth factor-alpha (TGF-alpha) are mediated by an interaction with a specific cell surface receptor having both intra- and extracellular domains. The structure of the intracellular domain can be closely aligned with retroviral protein tyrosine kinases. Upon ligand-binding there is a change in conformation of the extracellular domain, the receptor being converted to dimeric. Dimeric receptor has a higher rate of catalysis than monomeric and rapidly becomes phosphorylated. This form of the receptor now associates with and phosphorylates enzymes such as phospholipase-C, altering their catalytic activity and subcellular distribution. This system appears to stimulate the effects of epidermal growth factor receptor (EGFr) activation, notably proliferation, morphology, paracrine effects and differentiation. Coexpression of transforming growth factor alpha (TGF-alpha) and its receptor epidermal growth factor receptor (EGFR) is known to be associated with aggressive biologic behavior and adverse clinical outcome in a variety of tumors, for example, pancreatic adenocarcinomas.

The TGF-alpha precursor disclosed herein as SEC4 is expressed in at least the following tissues: apical microvilli of the retinal pigment epithelium, arterial (aortic), basal forebrain, brain, Burkitt lymphoma cell lines, corpus callosum, cardiac (atria and ventricle), caudate nucleus, CNS and peripheral tissue, cerebellum, cerebral cortex, colon, cortical neurogenic cells, endothelial (coronary artery and umbilical vein) cells, palate epithelia, eye, neonatal eye, frontal cortex, fetal hematopoietic cells, heart, hippocampus, hypothalamus, leukocytes, liver, fetal liver, lung, lung lymphoma cell lines, fetal lymphoid tissue, adult lymphoid tissue, those that express MHC I, II, and III, nervous tissues, medulla, subthalamic nucleus, ovary, pancreas, pituitary, placenta, pons, prostate, putamen, serum, skeletal muscle, small intestine, smooth muscle (coronary artery in aortia) spinal cord, spleen, stomach, taste receptor cells of the tongue, testis, thalamus, and thymus tissue. This information was derived by determining the tissue sources of the sequences that were included in the invention including but not limited to SeqCalling sources, public EST sources, literature sources, and/or RACE sources. Further expression data for SEC4 is provided in Example 2.

The nucleic acids and proteins of SEC4 are useful in potential therapeutic applications implicated in various SEC-related pathological disorders described further herein. The SEC4 nucleic acid encoding the TGF alpha-like protein of the invention, or fragments thereof, may further be useful in diagnostic applications, wherein the presence or amount of the nucleic acid or the protein are to be assessed.

These materials are further useful in the generation of antibodies that bind immunospecifically to the substances of the invention for use in therapeutic or diagnostic methods. These antibodies may be generated according to methods known in the art, using prediction from hydrophobicity charts, as described in the "Anti-SECX Antibodies" section below. The disclosed SEC4 protein has multiple hydrophilic regions, each of which can be used as an immunogen. In one embodiment, for example, a contemplated SEC4 epitope comprises from about amino acids 25 to about 50. In another embodiment, for example, a SEC4 epitope comprises from about amino acids 55 to about 75. In further embodiments, for example, a SEC4 epitope comprises from about 82 to about 105, and from about 135 to about 154.

SEC5

The disclosed SEC5 (alternatively referred to herein as CG56153-01) includes the 1293 nucleotide sequence (SEQ ID NO:9) shown in Table 5A. A SEC5 ORF begins with a Kozak consensus ATG initiation codon at nucleotides 144–146 and ends with a TAG codon at nucleotides 1086–1088. A putative untranslated region upstream from the initiation codon is underlined in Table 5A, and the start and stop codons are in bold letters.

TABLE 5A

SEC5 NUCLEOTIDE SEQUENCE

| |
|---|
| AGGTGGCGGGCGGGTACTTAAGGCGCGGCCACCGGGCTGGCAGTGCGCCCAACAGCGGAC (SEQ ID NO:9) |
| TCCGAGACCAGCGGATCTCGGCAAACCCTCTTTCTCGACCACCCACCTACCATTCTTGGA |
| ACCATGGCGGCAGTGGCGGCGGCCTCGGCTGAACTGCTCATCATCGGCTGGTACATCTTC |
| CGCGTGCTGCTGCAGGTGTTCCTGGAATGCTGCATTTACTGGGTAGGATTCGCTTTTCGA |
| AATCCTCCAGGGACACAGCCCATTGCGAGAAGTGAGGTGTTCAGGTACTCCCTGCAGAAG |
| CTGGCATACACGGTGTCGCGGACCGGGCGGCAGGTGTTGGGGGAGCGCAGGCAGCGAGCC |
| CCCAACTGAGGCCCCAGCTCCCAGCCCTGGGCGGCCGTATCATCAGGTGCTCCTGTGCAT |
| CTCGGCCAGCACGGGAGCCAGTGCCGCGCAGGAATGTGGGGTCCCCTGTGTTCCCTCGCC |
| AGAGCACTTGGCAAGGTCAGTGAGGGGCCAGTAGACCCCCGGAGAAGCAGTACCGACAAT |
| GACGAAGATACCAGATCCCTTCCCAACCCCTTTGCACCGGTCCCACTAAGGGGCAGGGTC |
| GAGAGAGGAGGGGGGATAGGGGGAGCAGACCCTGAGATCTGGGCATAGGCACCGCATTCT |
| GATCTGGACAAAGTCGGGACAGCACCATCCCAGCCCCGAAGCCCGGGCCATGCCAGCAGG |
| CCCCACCATGGAAATCAAAACACCGCACCAGCCAGCAGAATGGACATTCTGACATCGCCA |

TABLE 5A-continued

SEC5 NUCLEOTIDE SEQUENCE

GCCGACGCCCTGAATCTTGGTGCAGCACCCACCGCGTGCCTGTGTGGCGGGACTGGAGGG

CACAGTTGAGGAAGGAGGGTGGTTAAGAAATACAGTGGGGCCCTCTCGCTGTCCCTTGCC

CAGGGCACTTGTATTCCAGCCTCGCTGCATTTGCTCTCTCGATTGCCCCTTTCCTCCTAC

ATGCCTCCCAAGCCCACCCTACTCCAAAAGTAATGTGTCACTTGATTTGGAACTATTCAA

GCAGTAAAAGTAAATGAATCCCACCTTTACTAAAACACTTTCTCTGAACCCCCCTTGCCC

CTCACTGATCTTGCTTTTCCCTGGTCTCAGCAGTTGTGGTCAATATTGTGGTAATCGCTA

ATTGTACTGATTGTTTAAGTGTGCATTAGTTGTCTCTCCCAGCTAGATTGTAAGCTCCT

GGAGGACAGGGACCACCTCTACAAAAAATAAAAAAAGTACCTCCCCTGTCTCGCACAGTG

TCCCAGGACCCTGCGGTGCAGTAGAGGCGCACC

The SEC5 polypeptide (SEQ ID NO:10) encoded by SEQ ID NO:9 is 81 amino acids in length and is presented using the one-letter amino acid code in Table 5B. The Psort profile for SEC5 predicts that this sequence has a signal peptide and is likely to be localized at the plasma membrane with a certainty of 0.6850. In alternative embodiments, a SEC5 polypeptide is located to the Golgi body with a certainty of 0.3700, to the endoplasmic reticulum (membrane) with a certainty of 0.6400, or to peroxisomal microbodies with a certainty of 0.3200. The Signal P predicts a likely cleavage site for a SEC5 peptide is between positions 37 and 38, i.e., at the dash in the sequence GFA-FR.

TABLE 5B

SEC5 PROTEIN SEQUENCE

MAAVAAASAELLIIGWYIFRVLLQVFLECCIYWVGFAFRNPPGTQPIARSEVFRYSLQKL  (SEQ ID NO:10)

AYTVSRTGRQVLGERRQRAPN

A BLAST analysis of SEC5 was run against the proprietary PatP GENESEQ Protein Patent database. It was found, for example, that the amino acid sequence of SEC5 had high homology to other proteins as shown in Table 5C.

TABLE 5C

BLASTX results from PatP database for SEC5

| Sequences producing High-scoring Segment Pairs: | High Score | Smallest Sum Probability P(N) |
|---|---|---|
| patp: AAW79279 Human neuronatin amino acid sequence | 419 | 4.9e−39 |
| patp: AAR96044 Neuronatin-alpha - Rattus rattus | 409 | 5.7e−38 |
| patp: AAW79277 Rat neuronatin-alpha amino acid sequence | 409 | 5.7e−38 |
| patp: AAW37777 Human neuronatin amino acid sequence | 152 | 2.4e−22 |
| patp: AAR96045 Neuronatin-beta - Rattus rattus | 142 | 2.6e−21 |

In a search of public sequence databases, it was found, for example, that the amino acid sequence of the SEC5 protein of the present invention was found to have 81 of 81 amino acid residues (100%) identical to the 81 amino acid NM_005386. SEC5 also has homology to the proteins shown in the BLASTP data in Table 5D.

TABLE 5D

SEC5 BLASTP results

| Gene Index/Identifier | Protein/Organism | Length (aa) | Identity (%) | Positive (%) | Expect |
|---|---|---|---|---|---|
| gi\|4885521\|ref \|NP_005377.1\| (NM_005386) | neuronatin [*Homo sapiens*] | 81 | 81/81 (100) | 81/81 (100) | 6e−32 |
| gi\|6754864\|ref \|NP_035053.1\| (NM_010923) | neuronatin [*Mus musculus*] | 81 | 80/81 (98) | 81/81 (99) | 6e−32 |
| gi\|16758386\|ref \|NP_446053.1\| (NM_053601) | neuronatin; neuronatin alpha [*Rattus norvegicus*] | 81 | 79/81 (97) | 80/81 (98) | 7e−32 |
| gi\|12833393\|dbj \|BAB22507.1\| (AK003004) | putative [*Mus musculus*] | 208 | 75/80 (93) | 76/80 (94) | 2e−30 |
| gi\|1083432\|pir \|S51082 | neuronatin-1 - mouse | 55 | 75/80 (93) | 76/80 (94) | 2e−13 |

This BLASTP data is displayed graphically in the ClustalW in Table 5E. A multiple sequence alignment is given in Table 5E, with the SEC5 protein being shown on line 1, in a ClustalW analysis comparing the protein of the invention with the related protein sequences shown in Table 5D.

TABLE 5E

ClustalW Alignment of SEC5

```
1) SEC5         (SEQ ID NO:10)
2) gi|4885521|  (SEQ ID NO:61)
3) gi|6754864|  (SEQ ID NO:62)
4) gi|16758386| (SEQ ID NO:63)
5) gi|12833393| (SEQ ID NO:64)
6) gi|1083432|  (SEQ ID NO:65)

10        20        30        40        50
                ....|....|....|....|....|....|....|....|....|....|
SEC5            -MAAVAAASAELLIIGWYIFRVLLQVFLECCIYWVGFAFRNPPGTQPIAR
gi|4885521|     -MAAVAAASAELLIIGWYIFRVLLQVFLECCIYWVGFAFRNPPGTQPIAR
gi|6754864|     -MAAVAAASAELLIIGWYIFRVLLQVFLECCIYWVGFAFRNPPGTQPIAR
gi|16758386|    -MAAVAAASAELLIIGWYIFRVLLQVFLECCIYWVGFAFRNPPGTQPIAR
gi|12833393|    -MAAVAAASAELLIIGWYIFRVLLQVFLECCIYWVGFAFRNPPGTQPIAR
gi|1083432|     MVPKVAAASAELLIIGWYIFRVLLQ-------------------------

60        70        80        90       100
                ....|....|....|....|....|....|....|....|....|....|
SEC5            SEVFRYSLQKLANTVSRTGRQVLGERRQRAPN------------------
gi|4885521|     SEVFRYSLQKLANTVSRTGRQVLGERRQRAPN------------------
gi|6754864|     SEVFRYSLQKLAHTVSRTGRQVLGERRQRAPN------------------
gi|16758386|    SEVFRYSLQKLAHTVSRTGRQVLGERRHRAPN------------------
gi|12833393|    SEVFRYSLQKLAHTVSRTGRQVLGERSSEPPTEAPAPSPGRPCHQVLLCF
gi|1083432|     --VFRYSLQKLAHTVSRTGRQVLGERRQRAPN------------------

110       120       130       140       150
                ....|....|....|....|....|....|....|....|....|....|
SEC5            --------------------------------------------------
gi|4885521|     --------------------------------------------------
gi|6754864|     --------------------------------------------------
gi|16758386|    --------------------------------------------------
gi|12833393|    STAWEPVPRRNGGSLVLLVRVALAKVSEGPVAPRKAAPTMMKISVPFPAP
gi|1083432|     --------------------------------------------------

160       170       180       190       200
                ....|....|....|....|....|....|....|....|....|....|
SEC5            --------------------------------------------------
gi|4885521|     --------------------------------------------------
gi|6754864|     --------------------------------------------------
gi|16758386|    --------------------------------------------------
gi|12833393|    LPLSHYRRVGEEGGRGEQPSRYGRRHHILIWTKSEQYHLSRTRSYHEDRT
gi|1083432|     --------------------------------------------------

....|....
SEC5            ---------
gi|4885521|     ---------
gi|6754864|     ---------
gi|16758386|    ---------
gi|12833393|    AHQPAEWTF
gi|1083432|     ---------
```

Neuronatin, disclosed herein as SEC5, is a brain-specific human gene isolated and observed to be selectively expressed during brain development. The human gene spans 3973 bases and contains three exons and two introns. Based on primer extension analysis, a single cap site is located 124 bases upstream from the methionine (ATG) initiation codon, in good context, GAACCATGG. The promoter contains a modified TATA box, CATAAA (−27), and a modified CAAT box, GGCGAAT (−59). The 5'-flanking region contains putative transcription factor binding sites for SP-1, AP-2 (two sites), delta-subunit, SRE-2, NF-A 1, and ETS. In addition, a 21-base sequence highly homologous to the neural restrictive silence element that governs neuron-specific gene expression is observed at −421. Furthermore, SP-1 and AP-3 binding sites are present in intron 1. All splice donor and acceptor sites conformed to the GT/AG rule. Exon 1 encodes 24 amino acids, exon 2 encodes 27 amino acids, and exon 3 encodes 30 amino acids. At the 3'-end of the gene, the poly(A) signal, AATAAA, poly(A) site, and GT cluster are observed. The neuronatin gene is expressed as two mRNA species, alpha and beta, generated by alternative splicing. The alpha-form contains all three exons, whereas in the beta-form, the middle exon has been spliced out. The third nucleotide of all frequently used codons, except threonine, of neuronatin is either G or C, consistent with codon usage expected for Homo sapiens.

The human neuronatin gene on chromosome 20q11.2 is imprinted and transcribed specifically from the paternal allele. The region containing neuronatin has multiple CpG islands, and methylation analysis showed that a 1.8-kb CpG island in its promoter region exhibits differential methylation in all tissues examined. Neuronatin lies within the singular 8.5-kb intron of the gene encoding bladder cancer-associated protein (BLCAP). Northern blot analysis reveals that the human neuronatin message is expressed predominantly in the fetal brain in the brain-specific manner, but only faintly in the adult brain. Strong neuronatin expression is observed in the anterior pituitary gland, and in several human pituitary adenomas, including ACTH-producing, GH-producing, and nonfunctioning adenomas.

The SEC5 disclosed in this invention is expressed in at least the following tissues: apical microvilli of the retinal pigment epithelium, arterial (aortic), basal forebrain, brain, Burkitt lymphoma cell lines, corpus callosum, cardiac (atria and ventricle), caudate nucleus, CNS and peripheral tissue, cerebellum, cerebral cortex, colon, cortical neurogenic cells, endothelial (coronary artery and umbilical vein) cells, palate epithelia, eye, neonatal eye, frontal cortex, fetal hematopoietic cells, heart, hippocampus, hypothalamus, leukocytes, liver, fetal liver, lung, lung lymphoma cell lines, fetal lymphoid tissue, adult lymphoid tissue, those that express MHC I, II, and III, nervous tissues, medulla, subthalamic nucleus, ovary, pancreas, pituitary, placenta, pons, prostate, putamen, serum, skeletal muscle, small intestine, smooth muscle (coronary artery in aortia) spinal cord, spleen, stomach, taste receptor cells of the tongue, testis, thalamus, and thymus tissue. This information was derived by determining the tissue sources of the sequences that were included in the invention including but not limited to Seq-Calling sources, public EST sources, literature sources, and/or RACE sources.

Further expression data for SEC5 is provided in Example 2. The nucleic acids and proteins of SEC5 are useful in potential therapeutic applications implicated in various SEC-related pathological disorders described further herein. The SEC5 nucleic acid encoding the neuronatin-like protein of the invention, or fragments thereof, may further be useful in diagnostic applications, wherein the presence or amount of the nucleic acid or the protein are to be assessed.

These materials are further useful in the generation of antibodies that bind immunospecifically to the substances of the invention for use in therapeutic or diagnostic methods. These antibodies may be generated according to methods known in the art, using prediction from hydrophobicity charts, as described in the "Anti-SECX Antibodies" section below. The disclosed SEC5 protein has multiple hydrophilic regions, each of which can be used as an immunogen. In one embodiment, for example, a contemplated SEC5 epitope comprises from about amino acids 33 to about 38. In another embodiment, for example, a SEC5 epitope comprises from about amino acids 40 to about 81.

SEC6

The disclosed SEC6 (alternatively referred to herein as CG56157-01) includes the 679 nucleotide sequence (SEQ ID NO:11) shown in Table 6A. A SEC6 ORF begins with a Kozak consensus ATG initiation codon at nucleotides 70–72 and ends with a TAA codon at nucleotides 665–667.

TABLE 6A

| SEC6 NUCLEOTIDE SEQUENCE |
|---|
| GGCGGCGTTCGTGTCCGAGGTCACTAGTTTCCCGGTAGTTCAGCTGCACATGAATAGAAC (SEQ ID NO:11) |
| AGCAATGAGAGCCAGTCAGAAGGACTTTGAAAATTCAATAAATCAAGTGAAACTCTTGAA |
| AAAGGATCCAGGAAACGAAGTGAAGCTAAAACTCTACGCGCTATATAAGCAGGCCACTGA |
| AGGACCTTGTAACATGCCCAAACCAGGTGTATTTGACTTGATCAACAAGGCCAAATGGGA |
| CGCATGGAATGCCCTTGGCAGCCTGCCCAAGGAAGCTGCCAGGCAGAACTATGTGGATTT |
| GGTGTCCAGTTTGAGTCCTTCATTGGAATCCTCTAGTCAGGTGGAGCCTGGAACAGACAG |
| GAAATCAACTGGGTTTGAAACTCTGGTGGTGACCTCCGAAGATGGCATCACAAAGATCAT |
| GTTCAACCGGCCCAAAAAGAAAAATGCCATAAACACTGAGATGTATCATGAAATTATGCG |
| TGCACTTAAAGCTGCCAGCAAGGATGACTCAATCATCACTGTTTTAACAGGAAATGGTGA |
| CTATTACAGTAGTGGGAATGATCTGACTAACTTCACTGATATTCCCCCTGGTGGAGTANA |
| GGAGAAAGCTAAAAATAATGCCGTTTTACTGAAGGGAATTTGTGGGCTGTTTTATAGAAT |
| TTCCTAAGCCTCTGATTGC |

The SEC6 polypeptide (SEQ ID NO:12) encoded by SEQ ID NO:11 is 205 amino acids in length and is presented using the one-letter amino acid code in Table 6B. The Psort profile for SEC6 predicts that this sequence is likely to be localized at the nucleus with a certainty of 0.6000. In alternative embodiments, a SEC6 polypeptide is located to lysosomes with a certainty of 0.1000, or to the mitochondrial matrix space with a certainty of 0.3600.

TABLE 6B

SEC6 PROTEIN SEQUENCE

MNRTAMRASQKDFENSINQVKLLKKDPGNEVKLKLYALYKQATEGPCNMPKPGVFDLINK  (SEQ ID NO:12)

AKWDAWNALGSLPKEAARQNYVDLVSSLSPSLESSSQVEPGTDRKSTGFETLVVTSEDGI

TKIMFNRPKKKNAINTEMYHEIMRALKAASKDDSIITVLTGNGDYYSSGNDLTNFTDIPP

GGVXEKAKNNAVLLKGICGLFYRIS

A BLAST analysis of SEC6 was run against the proprietary PatP GENESEQ Protein Patent database. It was found, for example, that the amino acid sequence of SEC6 had high homology to other proteins as shown in Table 6C.

TABLE 6C

BLASTX results from PatP database for SEC6

| Sequences producing High-scoring Segment Pairs: | High Score | Smallest Sum Probability P(N) |
|---|---|---|
| patp: AAY07017 Breast cancer associated antigen precursor | 1044 | 2.9e−105 |
| patp: AAM93539 Human polypeptide | 999 | 1.7e−100 |
| patp: AAB81822 Human endozepine-like ENDO9 | 974 | 7.6e−98 |

TABLE 6C-continued

BLASTX results from PatP database for SEC6

| Sequences producing High-scoring Segment Pairs: | High Score | Smallest Sum Probability P(N) |
|---|---|---|
| patp: AAB63531 Human gastric cancer associated antigen | 956 | 6.1e−96 |

TABLE 6C-continued

BLASTX results from PatP database for SEC6

| Sequences producing High-scoring Segment Pairs: | High Score | Smallest Sum Probability P(N) |
|---|---|---|
| patp: AAB63535 Human gastric cancer associated antigen | 947 | 5.5e−95 |

In a search of public sequence databases, it was found, for example, that the amino acid sequence of the SEC6 protein of the present invention was found to have 193 of 210 amino acid residues (96%) identical to the 394 amino acid residue ptnr:SPTREMBL-ACC:Q9QW37 protein from Rattus sp (rat) (OR18 odorant receptor, E=4e-92). SEC6 also has homology to the proteins shown in the BLASTP data in Table 6D.

TABLE 6D

SEC6 BLASTP results

| Gene Index/Identifier | Protein/Organism | Length (aa) | Identity (%) | Positive (%) | Expect |
|---|---|---|---|---|---|
| gi\|12052810\|emb \|CAB66577.1\| (AL136642) | hypothetical protein [*Homo sapiens*] | 394 | 193/201 (96) | 195/201 (96) | e−109 |
| gi\|12803665\|gb \|AAH02668.1\| AAH02668 (BC002668) | peroxisomal D3, D2-enoyl-CoA isomerase [*Homo sapiens*] | 394 | 194/201 (96) | 196/201 (96) | e−102 |
| gi\|8574030\|emb \|CAB94781.1\| (AL033383) | dJ1013A10.3 (related to DBI (diazepam binding inhibitor (GABA receptor modulator, acyl-Coenzyme A binding protein)) [*Homo sapiens*] | 374 | 194/201 (96) | 196/201 (96) | e−101 |
| gi\|7670842\|gb \|AAF66247.1\| AF244138.1 (AF244138) | hepatocellular carcinoma-associated antigen 88 [*Homo sapiens*] | 364 | 194/201 (96) | 196/201 (96) | e−101 |
| gi\|3193336\|gb \|AAC19317.1\| (AF069301) | DBI-related protein [*Homo sapiens*] | 364 | 193/201 (96) | 195/201 (96) | e−100 |

This BLASTP data is displayed graphically in the ClustalW in Table 6E. A multiple sequence alignment is given in Table 6E, with the SEC6 protein being shown on line 1, in a ClustalW analysis comparing the protein of the invention with the related protein sequences shown in Table 6D.

TABLE 6E

ClustalW Alignment of SEC6

```
1) SEC6         (SEQ ID NO:12)
2) gi|12052810| (SEQ ID NO:66)
3) gi|12803665| (SEQ ID NO:67)
4) gi|8574030|  (SEQ ID NO:68)
5) gi|7672423|  (SEQ ID NO:69)
6) gi|3193336|  (SEQ ID NO:70)

10        20        30        40        50
                ....|....|....|....|....|....|....|....|....|....|
SEC6            ------------------------------MNRTAMRASQKDFENSMNQV
gi|12052810|    MAMAYLAWRLARRSCPSSLQVTSFPVVQLHMNRTAMRASQKDFENSMNQV
gi|12803665|    MAMAYLAWRLARRSCPSSLQVTSFPVVQLHMNRTAMRASQKDFENSMNQV
gi|8574030|     --------------------VTSFPVVQLHMNRTAMRASQKDFENSMNQV
gi|7672423|     --------------------MLLSILVALCLWLRLALGVRGAPCEAVRI
gi|3193336|     ------------------------------MNRTAMRASQKDFENSMNQV 60        70        80        90       100
                ....|....|....|....|....|....|....|....|....|....|
SEC6            KLLKKDPGNEVKLKLYALUKQATEGPCNMPKPGVFDLINKAKWDAWNALG
gi|12052810|    KLLKKDPGNEVKLKLYALUKQATEGPCNMPKPGVFDLINKAKWDAWNALG
gi|12803665|    KLLKKDPGNEVKLKLYALUKQATEGPCNMPKPGVFDLINKAKWDAWNALG
gi|8574030|     KLLKKDPGNEVKLKLYALUKQATEGPCNMPKPGVFDLINKAKWDAWNALG
gi|7672423|     PMCRHMEWNITRMPNHLHHSTQEN---AILAIGQYEELVDVNCSSVLSFF
gi|3193336|     KLLKKDPGNEVKLKLYALUKQATEGPCNMPKPGVFDLINKAKWDAWNALG 110       120       130       140       150
                ....|....|....|....|....|....|....|....|....|....|
SEC6            SLPKEAARQNYVDLVSSLPSLESSSQVEPGTDRKSTGFETLVVTSEDGI
gi|12052810|    SLPKEAARQNYVDLVSSLCPSLESSSQVEPGTDRKSTGFETLVVTSEDGI
gi|12803665|    SLPKEAARQNYVDLVSSLPSLESSSQVEPGTDRKSTGFETLVVTSEDGI
gi|8574030|     SLPKEAARQNYVDLVSSLPSLESSSQVEPGTDRKSTGFETLVVTSEDGI
gi|7672423|     LCAMYAPICTLEFLHDPIKPCKSVCQRARDDCEPLMKMYNHSWPESLACD
gi|3193336|     SLPKEAARQNYVDLVSSLPSLESSSQVEPGTDRKSTGFETLVVTSEDGI 160       170       180       190       200
                ....|....|....|....|....|....|....|....|....|....|
SEC6            TKIMFNR--PKKKNAINTEMYHEIMRALKAASKDDSIITVLTGNGDYYSS
gi|12052810|    TKIMFNR--PKKKNAINTEMYHEIMRALKAASKDDSIITVLTGNGDYYSS
gi|12803665|    TKIMFNR--PKKKNAINTEMYHEIMRALKAASKDDSIITVLTGNGDYYSS
gi|8574030|     TKIMFNR--PKKKNAINTEMYHEIMRALKAASKDDSIITVLTGNGDYYSS
gi|7672423|     ELPVYDRGVCISPEAIVLDLPEDVKWIDITP---DMMVQERSFDADCKHL
gi|3193336|     TKIMFNR--PKKKNAINTEMYHEIMRALKAASKDDSIITVLTGNGDCYSS 210       220       230       240       250
                ....|....|....|....|....|....|....|....|....|....|
SEC6            GNDLTNFTDIPPGGVEEKAKNNAVLLKGICGLFYRIS-------------
gi|12052810|    GNDLTNFTDIPPGGVEEKAKNNAVLLREFVGCFIDFPKPLIAVVNGPAVG
gi|12803665|    GNDLTNFTDIPPGGVEEKAKNNAVLLREFVGCFIDFPKPLIAVVNGPAVG
gi|8574030|     GNDLTNFTDIPPGGVEEKAKNNAVLLREFVGCFIDFPKPLIAVVNGPAVG
gi|7672423|     SPDRCKCKKVKPTLATYLSKNYSYVIHAKIKAVQRS--------GCNEVT
gi|3193336|     GNDLTNFTDIPPGGVEEKAKNNAVLLREFVGCFIDFPKPLIAVVNGPAVG 260       270       280       290       300
                ....|....|....|....|....|....|....|....|....|....|
SEC6            --------------------------------------------------
gi|12052810|    ISVTLLGLFDAVYASDRATFHTPFSHLGQSPEGCSSYTFPKIMSPAKATE
gi|12803665|    ISVTLLGLFDAVYASDRATFHTPFSHLGQSPEGCSSYTFPKIMSPAKATE
gi|8574030|     ISVTLLGLFDAVYASDRATFHTPFSHLGQSPEGCSSYTFPKIMSPAKATE
gi|7672423|     TVVDVKEIFKSSSPIPRTQVPLITNSSCQCPHILPHQDVLIMCYERRSRM
gi|3193336|     ISVTLLGLFDAVYASDRATFHTPFSHLGQSPEGCSSYTFPKIMSPAKATE 310       320       330       340       350
                ....|....|....|....|....|....|....|....|....|....|
SEC6            --------------------------------------------------
gi|12052810|    MLIFGKKLTAGEACAQGLVTEVFPDSTFQKEVWTRLKAFAKLPPNALRIS
gi|12803665|    MLIFGKKLTAGEACAQGLVTEVFPDSTFQKEVWTRLKAFAKLPPNALRIS
gi|8574030|     MLIFGKKLTAGEACAQGLVTEVFPDSTFQKEVWTRLKAFAKLPPNALRIS
gi|7672423|     MLLENCLVEK----WRDQLS--RRSTQWEERLQEQQRTTQDKKQIASRTS
gi|3193336|     MLIFGKKLTAGEACAQGLVTEVFPDSTFQKEVWTRLKAFAKLPPNVLRIS
```

TABLE 6E-continued

ClustalW Alignment of SEC6

```
                   360        370        380        390
              ....|....|....|....|....|....|....|....|....|.
SEC6          ----------------------------------------------
gi|12052810   KEVIRKREREKLHAVNAEECNVLQGRWLSDECTNAVVNFLSRKSKL
gi|12803665   KEVIRKREREKLHAVNAEECNVLQGRWLSDECTNAVVNFLSRKSKL
gi|8574030    KEVIRKREREKLHAVNAEECNVLQGRWLSDECTNAVVNFLSRKSKL
gi|7672423    RSNPPKPKGRSPASKPASPKKNIKARSAPKKSN-------PKKSTS
gi|3193336    KEVIRKREREKLHAVNAEECNVLQGRWLSDECTNAVVNFLSRKSKL
```

The presence of identifiable domains in SEC6, as well as all other SECX proteins, was determined by searches using software algorithms such as PROSITE, DOMAIN, Blocks, Pfam, ProDomain, and Prints, and then determining the Interpro number by crossing the domain match (or numbers) using the Interpro website (http:www.ebi.ac.uk/interpro). DOMAIN results for SEC6 as disclosed in Table 6F, were collected from the Conserved Domain Database (CDD) with Reverse Position Specific BLAST analyses. This BLAST analysis software samples domains found in the Smart and Plam collections. Fully conserved single residues are indicated by the sign (|) and "strong" semi-conserved residues are indicated by the sign (+). The "strong" group of conserved amino acid residues may be any one of the following groups of amino acids: STA, NEQK, NHQK, NDEQ, QHRK, MILV, MILF, HY, FYW.

Table 6F lists the domain description from DOMAIN analysis results against SEC6. This indicates that the SEC6 sequence has properties similar to those of other proteins known to contain this domain.

Mechanisms for formation of drug dependence and expression of withdrawal syndrome have not fully clarified despite of huge accumulation of experimental and clinical data at present. Several clinical features of withdrawal syndrome are considered to be common among patients with drug dependence induced by different drugs of abuse. One of them is anxiety. Recent investigations have revealed that diazepam binding inhibitor (DBI), disclosed herein as SEC6 serves as an inverse agonist for benzodiazepine (BZD) receptors with endogenously anxiogenic potential. Cerebral DBI expression in brain participates in the formation of drug dependence and/or emergence of withdrawal syndrome. Cerebral DBI expression significantly increases in mammals with drug dependence induced by drugs such as, for example, morphine, nicotine, and alcohol. In the cases of nicotine- and morphine-dependent mice concomitant administration of antagonists for nicotinic acetylcholine and opioid receptors, respectively, abolished the increase. Abrupt cessation of administration of drugs facilitated further increase in DBI expression. Therefore, these alterations in DBI expression have close relationship with formation of drug dependence and/or emergence of withdrawal syndrome, and are considered to be a common biochemical process in drug dependence induced by different drugs of abuse. DBI, and the modulation of DBI expression and activity thus provides for therapeutic targets for common biochemical pathways involved in drug dependence and provides a method of preventing the formation of drug dependence and/or the emergence of withdrawal syndromes.

The SEC6 disclosed in this invention is expressed in at least the following tissues: apical microvilli of the retinal pigment epithelium, arterial (aortic), basal forebrain, brain, Burkitt lymphoma cell lines, corpus callosum, cardiac (atria and ventricle), caudate nucleus, CNS and peripheral tissue, cerebellum, cerebral cortex, colon, cortical neurogenic cells, endothelial (coronary artery and umbilical vein) cells, palate epithelia, eye, neonatal eye, frontal cortex, fetal hematopoietic cells, heart, hippocampus, hypothalamus, leukocytes, liver, fetal liver, lung, lung lymphoma cell lines, fetal

TABLE 6F

DOMAIN ANALYSIS OF SEC6

```
gnl|Pfam|pfam00887, ACBP, Acyl CoA binding protein.
CD-Length = 85 residues, 89.4% aligned
Score = 101 bits (252), Expect = 4-23e
SEC 6:   9 SQKDFENSINQVKLLKKDPGNEVKLKLYALYKQATECPCNMPKPGVFDLINKAKWDAWNA  68   (SEQ ID NO:300)
            Q+ FE +  +VK LKK+P N+  L+LY+LYKQAT G CN  KPG+FDL  +AKWDAWN
Sbjct:   1 LQEQFEAAAEKVKKLKKNPSNDELLQLYSLYKQATVGDCNTEKPGMFDLKGRAKWDAWNE  60

SEC 6:  69 LGSLPKEAARQNYVDL  84
           L  + KE A + Y+
Sbjct:  61 LKGMSKEEAMKAYIAK  76
``` lymphoid tissue, adult lymphoid tissue, those that express MHC I, II, and III, nervous tissues, medulla, subthalamic nucleus, ovary, pancreas, pituitary, placenta, pons, prostate, putamen, serum, skeletal muscle, small intestine, smooth muscle (coronary artery in aortia) spinal cord, spleen, stomach, taste receptor cells of the tongue, testis, thalamus, and thymus tissue. This information was derived by determining the tissue sources of the sequences that were included in the invention including but not limited to Seq-Calling sources, public EST sources, literature sources, and/or RACE sources. Further expression data for SEC6 is provided in Example 2.

The nucleic acids and proteins of SEC6 are useful in potential therapeutic applications implicated in various SEC-related pathological disorders described further herein. The SEC6 nucleic acid encoding the DBI-like protein of the invention, or fragments thereof, may further be useful in diagnostic applications, wherein the presence or amount of the nucleic acid or the protein are to be assessed.

These materials are further useful in the generation of antibodies that bind immunospecifically to the substances of the invention for use in therapeutic or diagnostic methods. These antibodies may be generated according to methods known in the art, using prediction from hydrophobicity charts, as described in the "Anti-SECX Antibodies" section below. The disclosed SEC6 protein has multiple hydrophilic regions, each of which can be used as an immunogen. In one embodiment, for example, a contemplated SEC6 epitope comprises from about amino acids 1 to about 93. In another embodiment, for example, a SEC6 epitope comprises from about amino acids 95 to about 115. In further embodiments, for example, a SEC6 epitope comprises from about 120 to about 160, and from about 165 to about 195.

SEC7

The disclosed SEC7 (alternatively referred to herein as CG56159-01) includes the 3046 nucleotide sequence (SEQ ID NO:13) shown in Table 7A. A SEC7 ORF begins with a Kozak consensus ATG initiation codon at nucleotides 61–63 and ends with a TAG codon at nucleotides 2960–2962.

TABLE 7A

SEC7 NUCLEOTIDE SEQUENCE

TGGGGCTGCTCCGTTCTCTGCCTGGCCTGAGGCTCCCTGAGCCGCCTCCCCACCATCACC (SEQ ID NO:13)

ATGGCCAAGGGCTTCTATATTTCCAAGTCCCTGGGCATCCTGGGGATCCTCCTGGGCGTG

GCAGCCGTGTGCACAATCATCGCACTGTCAGTGGTGTACTCCCAGGAGAAGAACAAGAAC

GCCAACAGCTCCCCCGTGGCCTCCACCACCCCGTCCGCCTCAGCCACCACCAACCCCGCC

TCGGCCACCACCTTGGACCAAAGTAAAGCGTGGAATCGTTACCGCCTCCCCAACACGCTG

AAACCCGATTCCTACCAGGTGACGCTGAGACCGTACCTCACCCCCAATGACAGGGGCCTG

TACGTTTTTAAGGGCTCCAGCACCGTCCGTTTCACCTGCAAGGAGGCCACTGACGTCATC

ATCATCCACAGCAAGAAGCTCAACTACACCCTCAGCCAGGGGCACAGGGTGGTCCTGCGT

GGTGTGGGAGGCTCCCAGCCCCCCGACATTGACAAGACTGAGCTGGTGGAGCCCACCGAG

TACCTGGTGGTGCACCTCAAGGGCTCCCTGGTGAAGGACAGCCAGTATGAGATGGACAGC

GAGTTCGAGGGGGAGTTGGCAGATGACCTGGCGGGCTTCTACCGCAGCGAGTACATGGAG

GGCAATGTCAGAAAGGTGGTGGCCACTACACAGATGCAGGCTGCAGATGCCCGGAAGTCC

TTCCCATGCTTCGATGAGCCGGCCATGAAGGCCGAGTTCAACATCACGCTTATCCACCCC

AAGGACCTGACAGCCCTGTCCAACATGCTTCCCAAAGGTCCCAGCACCCCACTTCCAGAA

GACCCCAACTGGAATGTCACTGAGTTCCACACCACGCCCAAGATGTCCACGTACTTGCTG

GCCTTCATTGTCAGTGAGTTCGACTACGTGGAGAAGCAGGCATCCAATGGTGTCTTGATC

CGGATCTGGGCCCGGCCCAGTGCCATTGCGGCGGGCCACGGCGATTATGCCCTGAACGTG

ACGGGCCCCATCCTTAACTTCTTTGCTGGTCATTATGACACACCCTACCCACTCCCAAAA

TCAGACCAGATTGGCCTGCCAGACTTCAACGCCGGCGCCATGGAGAACTGGGGACTGGTG

ACCTACGGGAGAACTCCCTGCTGTTCGACCCCCTGTCCTCCTCCAGCAGCAACAAGGAG

CGGGTGGTCACTGTGATTGCTCATGAGCTGGCCCACCAGTGGTTCGGGAACCTGGTGACC

ATAGAGTGGTGGAATGACCTGTGGCTGAACGAGGGCTTCGCCTCCTACGTGGAGTACCTG

GGTGCTGACTATGCGGAGCCCACCTGGAACTTGAAAGACCTCATGGTGCTGAATGATGTG

TACCGCGTGATGGCAGTGGATGCACTGGCCTCCTCCCACCCGCTGTCCACACCCGCCTCG

GAGATCAACACGCCGGCCCAGATCAGTGAGCTGTTTGACGCGCATCTCCTACAGCAAGGGC

GCCTCAGTCCTCAGGATGCTCTCCAGCTTCCTGTCCGAGGACGTATTCAAGCAGGGCCTG

GCGTCCTACCTCCACACCTTTGCCTACCAGAACACCATCTACCTGAACCTGTGGGACCAC

CTGCAGGAGGCTGTGAACAACCGGTCCATCCAACTCCCCACCACCGAGCGGGACATCATG

AACCGCTGGACCCTGCAGATGGGCTTCCCGGTCATCACGGTGGATACCAGCACGGGGACC

CTTTCCCAGGAGCACTTCCTCCTTGACCCCGATTCCAATGTTACCCGCCCCTCAGAATTC

AACTACGTGTGGATTGTGCCCATCACATCCATCAGAGATGGCAGACAGCAGCAGGACTAC

TGGCTGATGGATGTAAGAGCCCAGAACGATCTCTTCAGCACATCAGGCAATGAGTGGGTC

TABLE 7A-continued

SEC7 NUCLEOTIDE SEQUENCE

CTGCTGAACCTCAATGTGACGGGCTATTACCGGGTGAACTACGACGAAGAGAACTGGAGG

AAGATTCAGACTCAGCTGCAGAGAGACCACTCGGCCATCCCTGTCATCAATCGGGCACAG

ATCATTAATGACGCCTTCAACCTGGCCAGTGCCCATAAGGTCCCTGTCACTCTGGCGCTG

AACAACACCCTCTTCCTGATTGAAGAGAGACAGTACATGCCCTGGGAGGCCGCCCTGAGC

AGCCTGAGCTACTTCAAGCTCATGTTTGACCGCTCCGAGGTCTATGGCCCCATGAAGAAC

TACCTGAAGAAGCAGGTCACACCCCTCTTCATTCACTTCAGAAATAATACCAACAACTGG

AGGGAGATCCCAGAAAACCTGATGGACCAGTACAGCGAGGTTAATGCCATCAGCACCGCC

TGCTCCAACGGAGTTCCAGAGTGTGAGGAGATGGTCTCTGGCCTTTTCAAGCAGTGGATG

GAGAACCCCAATAATAACCCGATCCACCCCAACCTGCGGTCCACCGTCTACTGCAACGCT

ATCGCCCAGGGGCGGGGAGGAGGAGTGGACTTCGCCTGGGAGCAGTTCCGAAATGCCACA

CTGGTCAATGAGGCTGACAAGCTCCGGGCAGCCCTGGCCTGCAGCAAAGAGTTGTGGATC

CTGAACAGGTACCTGAGCTACACCCTGAACCCGGACTTAATCCGGAAGCAGGACGCCACC

TCTACCATCATCAGCATTACCAACAACGTCATTGGGCAAGGTCTGGTCTGGGACTTTGTC

CAGAGCAACTGGAAGAAGCCTTTTAACGATTATGGTGGTGGCTCGTTCTCCTTCTCCAAC

CTCATCCAGGCAGTGACACGACGATTCTCCACCGAGTATGAGCTGCAGCAGCTGGAGCAG

TTCAAGAAGGACAACGAGGAAACAGGCTTCGGCTCAGGCACCCGGGCCCTGGAGCAAGCC

CTGGAGAAGACGAAAGCCAACATCAAGTGGGTGAAGGAGAACAAGGAGGTGGTGCTCCAG

TGGTTCACAGAAAACAGCAAATAGTCCCCAGCCCTTGAAGCTACCCGGCCCCGATCGAAG

GTGCCCACATGTGTCCATCCCAGCGGCTGGTGCAGGGCCTCCATTC

The SEC7 polypeptide (SEQ ID NO:14) encoded by SEQ ID NO:13 is 967 amino acids in length and is presented using the one-letter amino acid code in Table 7B. The Psort profile for SEC7 predicts that this sequence has a signal peptide and is likely to be secreted from the cell with a certainty of 0.8200. In alternative embodiments, a SEC7 polypeptide is located to lysosomes with a certainty of 0.1900, to the endoplasmic reticulum with a certainty of 0.1000. The Signal P predicts a likely cleavage site for a SEC7 peptide is between positions 34 and 35, i.e., at the dash in the sequence VYS-QE.

TABLE 7B

SEC7 PROTEIN SEQUENCE

MAKGFYISKSLGILGILLGVAAVCTIIALSVVYSQEKNKNANSSPVASTTPSASATTNPA (SEQ ID NO:14)

SATTLDQSKAWNRYRLPNTLKPDSYQVTLRPYLTPNDRGLYVFKGSSTVRFTCKEATDVI

IIHSKKLNYTLSQGHRVVLRGVGGSQPPDIDKTELVEPTEYLVVHLKGSLVKDSQYEMDS

EFEGELADDLAGFYRSEYMEGNVRKVVATTQMQAADARKSPPCPDEPAMKAEFNITLIHP

KDLTALSNMLPKGPSTPLPEDPNWNVTEFHTTPKMSTYLLAFIVSEFDYVEKQASNGVLI

RIWARPSAIAAGHGDYALNVTGPILNFFAGHYDTPYPLPKSDQIGLPDFNAGAMENWGLV

TYRENSLLFDPLSSSSSNKERVVTVIAHELAHQWFGNLVTIEWWNDLWLNEGFASYVEYL

GADYAEPTWNLKDLMVLNDVYRVMAVDALASSHPLSTPASEINTPAQISELFDAISYSKG

ASVLRMLSSFLSEDVFKQGLASYLMTFAYQNTIYLNLWDHLQEAVNNRSIQLPTTERDIM

NRWTLQMGFPVITVDTSTGTLSQEHFLLDPDSNVTRPSEFNYVWIVPITSIRDGRQQQDY

WLMDVRAQNDLFSTSGNEWVLLNLNVTGYYRVNYDEENWRKIQTQLQRDHSAIPVINRAQ

TABLE 7B-continued

SEC7 PROTEIN SEQUENCE

IINDAFNLASAHKVPVTLALNNTLFLIEERQYMPWEAALSSLSYFKLMFDRSEVYGPMKN

YLKKQVTPLFIHFRNNTNNWREIPENLMDQYSEVNAISTACSNGVPECEEMVSGLFKQWM

ENPNNNPIHPNLRSTVYCNAIAQGGEEEWDFAWEQFRNATLVNEADKLRAALACSKELWI

LNRYLSYTLNPDLIRKQDATSTIISITNNVIGQGLVWDFVQSNWKKPFNDYGGGSFSFSN

LIQAVTRRFSTEYELQQLEQFKKDNEETGFGSGTRALEQALEKTKANIKWVKENKEVVLQ

WFTENSK

A BLAST analysis of SEC7 was run against the proprietary PatP GENESEQ Protein Patent database. It was found, for example, that the amino acid sequence of SEC7 had high homology to other proteins as shown in Table 7C.

TABLE 7C

BLASTX results from PatP database for SEC7

| Sequences producing High-scoring Segment Pairs: | High Score | Smallest Sum Probability P(N) |
|---|---|---|
| patp: AAW93621 Human CD13/aminopeptidase N protein | 5066 | 0.0 |
| patp: AAB54345 Human pancreatic cancer antigen protein | 5059 | 0.0 |
| patp: AAU12270 Human PRO5995 polypeptide sequence | 1486 | 4.2e–152 |
| patp: AAB24422 Human PRO1154 protein | 1279 | 3.6e–130 |

TABLE 7C-continued

BLASTX results from PatP database for SEC7

| Sequences producing High-scoring Segment Pairs: | High Score | Smallest Sum Probability P(N) |
|---|---|---|
| patp: AAY66736 Membrane-bound protein PRO1154 | 1279 | 3.6e–130 |

In a search of public sequence databases, it was found, for example, that the amino acid sequence of the SEC7 protein of the present invention was found to have 734 of 967 amino acid residues (75%) identical to the 996 amino acid NM_008486. SEC7 also has homology to the other proteins shown in the BLASTP data in Table 7D.

TABLE 7D

SEC7 BLASTP results

| Gene Index/Identifier | Protein/Organism | Length (aa) | Identity (%) | Positive (%) | Expect |
|---|---|---|---|---|---|
| gi\|6678664\|ref\|NP_032512.1\| (NM_008486) | leucine arylaminopeptidase 1, intestinal; aminopeptidase M; aminopeptidase N; microsomal aminopeptidase [*Mus musculus*] | 966 | 734/967 (75) | 841/967 (86) | 0.0 |
| gi\|1351929\|sp\|P15541\|AMPN_RABIT | AMINOPEPTIDASE N (MICROSOMAL AMINOPEPTIDASE) (LEUKEMIA ANTIGEN CD13) | 966 | 772/970 (79) | 869/970 (89) | 0.0 |
| gi\|16877511\|gb\|AAH17011.1\|AAH17011 (BC017011) | Similar to alanyl (membrane) aminopeptidase [*Mus musculus*] | 974 | 738/975 (75) | 840/975 (85) | 0.0 |
| gi\|4502095\|ref\|NP_001141.1\| (NM_001150) | membrane alanine aminopeptidase precursor; microsomal aminopeptidase; Alanyl (membrane) aminopeptidase (aminopeptidase N, aminopeptidase M, [*Homo sapiens*] | 967 | 964/967 (99) | 965/967 (99) | 0.0 |
| gi\|113743\|sp\|P15144\|AMPN_HUMAN | AMINOPEPTIDASE N (MICROSOMAL AMINOPEPTIDASE) (GP150) (MYELOID PLASMA MEMBRANE GLYCOPROTEIN CD13) | 967 | 967/967 (100) | 967/967 (100) | 0.0 |

This BLASTP data is displayed graphically in the ClustalW in Table 7E. A multiple sequence alignment is given in Table 7E, with the SEC7 protein being shown on line 1, in a ClustalW analysis comparing the protein of the invention with the related protein sequences shown in Table 7D.

TABLE 7E

ClustalW Alignment of SEC7

```
1) SEC7           (SEQ ID NO:14)
2) gi|6678664|    (SEQ ID NO:71)
3) gi|1351929|    (SEQ ID NO:72)
4) gi|16877511|   (SEQ ID NO:73)
5) gi|4502095|    (SEQ ID NO:74)
6) gi|113743|     (SEQ ID NO:75)

10        20        30        40        50
                ....|....|....|....|....|....|....|....|....|....|
SEC7            MAKGFYISKSLGILGILLGVAAVCTIIALSVVYSQEKNKNANSSPVASTT
gi|6678664|     MAKGFYISKTLGILGILLGVAAVCTIIALSVVYAQEKNRNAENSATAPTL
gi|1351929|     MAKGFYISKSLGILGILLGVAALCTIVALSVVYRQEKNKNTSQSPSMAPL
gi|16877511|    MAKGFYISKTLGILGILLGVAAVCTIIALSVVYAQEKNRNAENSATAPTL
gi|4502095|     MAKGFYISKSLGILGILLGVAAVCTIIALSVVYSQEKNKNANSSPVASTT
gi|113743|      MAKGFYISKSLGILGILLGVAAVCTIIALSVVYSQEKNKNANSSPVASTT 60        70        80        90       100
                ....|....|....|....|....|....|....|....|....|....|
SEC7            PSASATTNEAS--------ATTLDQSKAWNYRLPNTLKPDSYQVTLRPY
gi|6678664|     PGSTSATTATT--------TPAVDESKPWNQYRLPKTLIPDAYRVILRPY
gi|1351929|     N-PTATSSE----------ATTLDQNLPWNYRLPKTLIPDSYNVVLRPY
gi|16877511|    PGSTSATTATTTATTTATTTPAVDESKPWNQYRLPKTLIPDSYRVILRPY
gi|4502095|     PSASATTNEAS--------ATTLDQSKAWNYRLPNTLKPDSYQVTLRPY
gi|113743|      PSASATTNEAS--------ATTLDQSKAWNYRLPNTLKPDSYQVTLRPY 110       120       130       140       150
                ....|....|....|....|....|....|....|....|....|....|
SEC7            LTPNDRGLYVFKGSSTVRFTCKEATDVIIIHSKKLNYTLSQGHRVVLRGV
gi|6678664|     LTPNNQGLYIFQGNSTVRFTCNQTTDVIIIHSKKLNYTLKGNHRVVLRTL
gi|1351929|     LSPNSQGLYIFTGSSTVRFTCQEATNVIIIHSKKLNYTITQGHRVVLRGV
gi|16877511|    LTPNNQGLYIFQGSSTVRFTCNQTTDVIIIHSKKLNYTLKGNHRVVLRTL
gi|4502095|     LTPNDRGLYVFKGSSTVRFTCKEATDVIIIHSKKLNYTLSQGHRVVLRGV
gi|113743|      LTPNDRGLYVFKGSSTVRFTCKEATDVIIIHSKKLNYTLSQGHRVVLRGV 160       170       180       190       200
                ....|....|....|....|....|....|....|....|....|....|
SEC7            GGSQPPDIDKTELVEPTEYLVVHLKGSLVKDSQYEMDSEFEGELADDLAG
gi|6678664|     DGTPAPNIDKTELVERTEYLVVHLQGSLVEGRQYEMDSQFQGELADDLAG
gi|1351929|     RGSQPPAIASTELVELTEYLVVHLQGQLVAGSQYEMDTQFQGELADDLAG
gi|16877511|    DGTPAPNIDKTELVERTEYLVVHLQGSLVEGRQYEMDSEFQGELADDLAG
gi|4502095|     GGSQPPDIDKTELVEPTEYLVVHLKGSLVKDSQYEMDSEFEGELADDLAG
gi|113743|      GGSQPPDIDKTELVEPTEYLVVHLKGSLVKDSQYEMDSEFEGELADDLAG 210       220       230       240       250
                ....|....|....|....|....|....|....|....|....|....|
SEC7            FYRSEYMEGNVRKVVATTQMQAADARKSFPCFDEPAMKAEFNITLIHPKD
gi|6678664|     FYRSEYMEGDVKKVVATTQMQAADARKSFPCFDEPAMKAMFNITLIYPNN
gi|1351929|     FYRSEYMEGNVRKVVATTQMQAADARKSFPCFDEPAMKATFNITPIHPRD
gi|16877511|    FYRSEYMEGGVKKVVATTQMQAADARKSFPCFDEPAMKAMFNITLIYPNN
gi|4502095|     FYRSEYMEGNVRKVVATTQMQAADARKSFPCFDEPAMKAEFNITLIHPKD
gi|113743|      FYRSEYMEGNVRKVVATTQMQAADARKSFPCFDEPAMKAEFNITLIHPKD 260       270       280       290       300
                ....|....|....|....|....|....|....|....|....|....|
SEC7            LTALSNMLPKGPSTPLPEDPNWNVTEFHTTPKMSTYLLAFIVSEFDYVEK
gi|6678664|     LIALSNMLPK-ESKPYPEDPSCTMTEFHSTPKMSTYLLAYIVSEFKNISS
gi|1351929|     YTALSNMLPR-SSTALPEDPNWTVTEFHTTPKMSTYLLAYIVSEFTNIEA
gi|16877511|    LIALSNMLPK-ESKPYPEDPSCTMTEFHSTPKMSTYLLAYIVSEFKNISS
gi|4502095|     LTALSNMLPKGPSTPLPEDPNWNVTEFHTTPKMSTYLLAFIVSEFDYVEK
gi|113743|      LTALSNMLPKGPSTPLPEDPNWNVTEFHTTPKMSTYLLAFIVSEFDYVEK 310       320       330       340       350
                ....|....|....|....|....|....|....|....|....|....|
SEC7            QASNGVLIRIWARPSAIAAGHGDYALNVTGPILNFFAGHYDTPYPLPKSD
gi|6678664|     VSANGVQIGIWARPSAIDEGQQGDYALNVTGPILNFFAQHYSYPLPKSD
gi|1351929|     QSPNNVQIRIWARPSAISEGHGQYALNVTGPILNFFANHYNPYPLPKSD
gi|16877511|    VSANGVQIGIWARPSAIDEGQGDYALNVTGPILNFFAQHYNTSYPLPKSD
gi|4502095|     QASNGVLIRIWARPSAIAAGHGDYALNVTGPILNFFAGHYDTPYPLPKSD
gi|113743|      QASNGVLIRIWARPSAIAAGHGDYALNVTGPILNFFAGHYDTPYPLPKSD
```

TABLE 7E-continued

ClustalW Alignment of SEC7

```
               360        370        380        390        400
            ....|....|....|....|....|....|....|....|....|....|
SEC7        QIGLPDFNAGAMENWGLVTYRENSLLFDPLSSSSNKERVVTVIAHELAH
gi|6678664| QIALPDFNAGAMENWGLVTYRESSLVFDSQSSSISNKERVVTVIAHELAH
gi|1351929| QIGLPDFNAGAMENWGLVTYRESALLFDPLVSSISNKERVVTVVAHELAH
gi|16877511|QIALPDFNAGAMENWGLVTYRESSLVFDSQSSSISNKERVVTVIAHELAH
gi|4502095| QIGLPDFNAGAMENWGLVTYRENSLLFDPLSSSSNKERVVTVIAHELAH
gi|113743|  QIGLPDFNAGAMENWGLVTYRENSLLFDPLSSSSNKERVVTVIAHELAH 410        420        430        440        450
            ....|....|....|....|....|....|....|....|....|....|
SEC7        QWFGNLVTIEWWNDLWLNEGFASYVEYLGADYAEPTWNLKDLMVLNDVYR
gi|6678664| QWFGNLVTVAWWNDLWLNEGFASYVEYLGADYAEPTWNLKDLMVLNDVYR
gi|1351929| QWFGNLVTVDWWNDLWLNEGFASYVEYLGADYAEPTWNLKDLIVLNELHS
gi|16877511|QWFGNLVTVAWWNDLWLNEGFASYVEYLGADYAEPTWNLKDLMVLNDVYR
gi|4502095| QWFGNLVTIEWWNDLWLNEGFASYVEYLGADYAEPTWNLKDLMVLNDVYR
gi|113743|  QWFGNLVTIEWWNDLWLNEGFASYVEYLGADYAEPTWNLKDLMVLNDVYR 460        470        480        490        500
            ....|....|....|....|....|....|....|....|....|....|
SEC7        VMAVDALASSHPLSTPASEINTPAQISELFDAISYSKGASVLRMLSSFLS
gi|6678664| VMAVDALASSHPLSSPADEIKTPDQIMELFDSIRYSKGASVIRMLSSFLT
gi|1351929| VMAVDALASSHPLSSPADEVNTPAQISELFDSIIYSKGASVIRMLSSFLT
gi|16877511|VMAVDALASSHPLSSPADEIKTPDQIMELFDSITYSKGASVIRMLSSFLT
gi|4502095| VMAVDALASSHPLSTPASEINTPAQISELFDAISYSKGASVLRMLSSFLS
gi|113743|  VMAVDALASSHPLSTPASEINTPAQISELFDAISYSKGASVLRMLSSFLS 510        520        530        540        550
            ....|....|....|....|....|....|....|....|....|....|
SEC7        EDVFKQGLASYLHTFAYQNTIYLNLWDHLQEAVNNR-SIQLPTIERDIMN
gi|6678664| EDLFKKGLSSYLHTYQYSNTVYLELWEHLQKAVNQQTAVQPPAIVRTIMN
gi|1351929| EDLFKEGLASYLHTFAYQNTIYLDLWEHLQQAVNSQSAIQLPAEVRDIMN
gi|16877511|EDLFKKGLSSYLHTYQYSNTVYLELWEHLQKAVNQQTAVQPATVRTIMN
gi|4502095| EDVFKQGLASYLHTFAYQNTIYLNLWDHLQEAVNNR-SIQLPTTVRDIMN
gi|113743|  EDVFKQGLASYLHTFAYQNTIYLNLWDHLQEAVNNR-SIQLPTIERDIMN 560        570        580        590        600
            ....|....|....|....|....|....|....|....|....|....|
SEC7        RWTLQMGFPVITVDTSTGTLSQEHFLLDPDSNVTRPSEFNYVWIVPIHSI
gi|6678664| RWILQMGFPVITVNTNTGEISQEHFLLDSKSNVTRPSEFNYIWIAPIPFL
gi|1351929| RWILQMGFPVVTVNTTNGIISQEHFLLDPTSNVTRPSDFNYIWIVPVSSM
gi|16877511|RWILQMGFPVITVNTSTGEISQEHFLLDSKSNVTRPSEFNYIWIAPIPFL
gi|4502095| RWTLQMGFPVITVDTSTGTLSQEHFLLDPDSNVTRPSEFNYVWIVPIHSI
gi|113743|  RWTLQMGFPVITVDTSTGTLSQEHFLLDPDSNVTRPSEFNYVWIVPIHSI 610        620        630        640        650
            ....|....|....|....|....|....|....|....|....|....|
SEC7        RDGRQQDYWLMDVR-AQNDLFSTSG-NEWVLLNLNVTGYYRVNYDEENW
gi|6678664| KSG-QEDHYWLDVEK-NQSAKFQTSS-NEWILLNINVTGYYLVNYDENNW
gi|1351929| RNGVLEQEFWLEGVEQTQNSLRVEGDNNWILANLNVTGYYQVNYDEGNW
gi|16877511|KSG-QEDHYWLDVEK-NQSAKFQTSS-NEWILLNINVTGYYLVNYDENNW
gi|4502095| RDGRQQDYWLMDVR-AQNDLFSTSG-NEWVLLNLNVTGYYRVNYDEENW
gi|113743|  RDGRQQDYWLMDVR-AQNDLFSTSG-NEWVLLNLNVTGYYRVNYDEENW 660        670        680        690        700
            ....|....|....|....|....|....|....|....|....|....|
SEC7        RKIQTQLQRDHSAIPVINRAQIINDAFNLASAHKVPVTLALNNTLFLIEE
gi|6678664| KKEQNLQTDLSVIPVINRAQIIHDSFNLASAKMIPITLALDNTLFLVKE
gi|1351929| KKIQTQLQTNPSVIPVINRAQIIHDAFNLASAQKVPVTLALDNTLFLIRE
gi|16877511|KKEQNLQTDLSVIPVINRAQIIHDSFNLASAKMIPITLALDNTLFLVKE
gi|4502095| RKIQTQLQRDHSAIPVINRAQIINDAFNLASAHKVPVTLALNNTLFLIEE
gi|113743|  RKIQTQLQRDHSAIPVINRAQIINDAFNLASAHKVPVTLALNNTLFLIEE 710        720        730        740        750
            ....|....|....|....|....|....|....|....|....|....|
SEC7        RQYMPWEAALSSLSYFKLMFDRSEVYGPMKNYLKKQVTPLFIHRNNTNN
gi|6678664| AEYMPWQAALSSLNYFTLMFDRSEVYGPMKRYLKKQVTPLFFYPQNRTNN
gi|1351929| TEYMPWQAALSSLNYFKLMFDRSEVYGPMKNYLSKQVRPLFEHPKNITNE
gi|16877511|TEYMPWQAALSSLNYFTLMFDRSEVYGPMKRYLKKQMPLFFYPQNRITNN
gi|4502095| RQYMPWEAALSSLSYFKLMFDRSEVYGPMKNYLKKQVTPLFIHRNNTNN
gi|113743|  RQYMPWEAALSSLSYFKLMFDRSEVYGPMKNYLKKQVTPLFIHRNNTNN 760        770        780        790        800
            ....|....|....|....|....|....|....|....|....|....|
SEC7        WREIPENLMDQYSEVNAISTACSNGVPECEEMVSGLFKQWMENPNNPIH
gi|6678664| WVNRPPTLMEQYNEINAISTACSSGLKECRDLVVELYSQWMKNPNNTIH
gi|1351929| WTRRPDTLMDQYNEINAISTACSIQEQEDHLSDLFKQWMDDPSNNPIH
gi|16877511|WVNRPPTLMEQYNEINAISTACSSGLKECRDLVVELYSQWMKNPNNTIH
gi|4502095| WREIPENLMDQYSEVNAISTACSNGVPECEEMVSGLFKQWMENPNNPIH
gi|113743|  WREIPENLMDQYSEVNAISTACSNGVPECEEMVSGLFKQWMENPNNPIH
```

TABLE 7E-continued

ClustalW Alignment of SEC7

```
                  810       820       830       840       850
            ....|....|....|....|....|....|....|....|....|....|
SEC7        PNLRSTVYCNAIAQGGEEEWDFAWEQFRNATLVNEADKLRAALACSKEW
gi|6678664| PNLRSTVYCNAIAFGGEEEWNFAWEQFRNATLVNEADKLRSALACSKDYW
gi|1351929| PNLRTTVYCNAIALGGREWDFAWEQFRNATLVNEADKLRSALACSNEYW
gi|16877511|PNLRSTVYCNAIAFGGEEEWMFAWEQFRNATLVNEADKLRSALACSKDVW
gi|4502095| PNLRSTVYCNAIAQGGEEEWDFAWEQFRNATLVNEADKLRAALACSKEW
gi|113743|  PNLRSTVYCNAIAQGGEEEWDFAWEQFRNATLVNEADKLRAALACSKEW 860       870       880       890       900
            ....|....|....|....|....|....|....|....|....|....|
SEC7        ILNRYLSYTLNPDLIRKQDATSTIISITNNVIGQGLVWDFVQSNWKKPFN
gi|6678664| ILNRYLSYTLNPDYIRKQDTTSTIISIASNVAGHPLVWDFVRSNWKKLFE
gi|1351929| ILNRYLSYTLNPDYIRRQDATSTINSIASNVIGQTLVWDFVQSNWKKLFE
gi|16877511|ILNRYLSYTLNPDYIRKQDTTSTIISIASNVAGHPLVWDFVRSNWKKLFE
gi|4502095| ILNRYLSYTLNPDLIRKQDATSTIISITNNVIGQGLVWDFVQSNWKKLFN
gi|113743|  ILNRYLSYTLNPDLIRKQDATSTIISITNNVIGQGLVWDFVQSNWKKPFN 910       920       930       940       950
            ....|....|....|....|....|....|....|....|....|....|
SEC7        DYGGGSFSFSNLIQAVTRRFSTEYELQQLEQFKKDNEETGFGSGTRALEQ
gi|6678664| NYGGGSFSFANLIQGVTRRFSSERELQQLEQFKADNSATGFGTGTRALEQ
gi|1351929| DFGGGSFSFANLIRAVTRRFSTEYELQQLEQFRLKNLDTGFGSGTRALEQ
gi|16877511|NYGGGSFSFANLIQGVTRRFSSDEELQQLEQFKADNSATGFGTGTRALEQ
gi|4502095| DYGGGSFSFSNLIQAVTRRFSTEYELQQLEQFKKDNEETGFGSGTRALEQ
gi|113743|  DYGGGSFSFSNLIQAVTRRFSTEYELQQLEQFKKDNEETGFGSGTRALEQ 960       970
            ....|....|....|....|....|...
SEC7        ALEKTKANIKWVKENKEVVLQWFTENSK
gi|6678664| ALEKTRANIDWVKENKDAVFKWFTENSS
gi|1351929| ALEQTRANIKWVQENKEAVIAWFTANSA
gi|16877511|ALEKTRANIDWVKENKDAVFKWFTENSS
gi|4502095| ALEKTKANIKWVKENKEVVLQWFTENSK
gi|113743|  ALEKTKANIKWVKENKEVVLQWFTENSK
```

The presence of identifiable domains in SEC7, as well as all other SECX proteins, was determined by searches using software algorithms such as PROSITE, DOMAIN, Blocks, Pfam, ProDomain, and Prints, and then determining the Interpro number by crossing the domain match (or numbers) using the Interpro website (http:www.ebi.ac.uk/interpro). DOMAIN results for SEC7 as disclosed in Table 7F, were collected from the Conserved Domain Database (CDD) with Reverse Position Specific BLAST analyses. This BLAST analysis software samples domains found in the Smart and Pfam collections. Fully conserved single residues are indicated by the sign (|) and "strong" semi-conserved residues are indicated by the sign (+). The "strong" group of conserved amino acid residues may be any one of the following groups of amino acids: STA, NEQK, NHQK, NDEQ, QHRK, MILV, MILF, HY, FYW.

Table 7F lists the domain description from DOMAIN analysis results against SEC7. This indicates that the SEC7 sequence has properties similar to those of other proteins known to contain this domain.

TABLE 7F

DOMAIN ANALYSIS OF SEC7

```
gn|Pfam|pfam01433, Peptidase_M1, Peptidase family M1. Members of this family
are aminopeptidases. The members differ widely in specificity, hydrolysing acidic,
basic or neutral N-terminal residues. This family includes leukotriene-A4 hydrolase,
this enzyme also has an aminopeptidase activity.
CD-Length = 393 residues, 100.0% aligned
Score = 461 bits (1186), Expect = 9e-131

SEC 7:     76 LPNTLKPDSYQVTLRPYLTPNDRGLYVEKGSSTVRFTCK-EATDVIIIHSKKLNYTLSQG 134
              LP  + P  Y +L      TP       F GS T+         TD I++H+K L
Sbjct:      1 LPTNVVPIHYDLRL----TPFLPEKPTFSGSVTITLQATIAGTDEIVLHAKDLTI----- 51  (SEQ ID NO: 301)

SEC 7:    135 HRVVLRGVGGSQPPDIDKTELVEPTEYLVVHLKGSLVKDSQYEMDSEFEGELADDLAGFY 194
                V L GV GS P  ++   L + T+ L + L  SL    QY ++ ++ G+++D + GFY
Sbjct:     52 SSVTLVGVNGSTPESVE-FSLQDETQKLTITLPQSLSAGQQYTLEIDYTGKISDSMLGFY 110

SEC 7:    195 RSEYMEG--NVRKVVATTQMQAADARKSFPCFDEPAMKAEFNITLIHPKDLTALSNMLPK 252
              RSEY +G      K +ATTQ +   DAR++FPCFDEP+ KA F IT+ HPK   TALSNM
Sbjct:    111 RSEYTDGGDGETKYMATTQFEPTDARRAFPCFDEPSFKATFTITITHPKGSTALSNMPVI 170

SEC 7:    253 GPSTPLPEDPNWNVTEFHTTPKMSTYLLAFIVSEFDYVEKQASNGVLIRIWARPSAIAAG 312
                 +      +D     +T F TTP MSTYLLAF+V +   Y+E +   +GV +R++ARP A   AG
Sbjct:    171 TTT---KDDDGRVITTFETTPPMSTYLLAFVVGDLTYLETETKDGVPVRVYARPGAKMAG 227
```

TABLE 7F-continued

DOMAIN ANALYSIS OF SEC7

```
SEC 7:    313  HGDYALNVTGPILNFFAGHYDTPYPLPKSDQICLPDENAGAMENWGLVTYRENSLLFDPL  372
               G YAL+VT  +L F+   ++   PYPLPK DQ+ +PDF+AGAMENWGL+TYRE +LL+DP
Sbjct:    228  QGQYALDVTKKLLEFYEEYFGYPYPLPKLDQVAVPDFSAGAMENWGLITYREPALLYDPR  287

SEC 7:    373  SSSSSNKERVVTVIAHELAHQWFGNLVTIEWWNDLWLNEGFASYVEYLGAD--YAEPTWN  430
               SS++SNK+RV +VIAHELAHQWFGNLVT++WW+DLWLNEGFA+Y+EYL D      EPTWN
Sbjct:    288  SSTNSNKQRVASVIAHELAHQWFGNLVTMKWWDDLWLNEGFATYLEYLITDELGGEPTWN  347

SEC 7:    431  LKDLMVLNDVYRVMAVDALASSHPLSTPASEINTPAQISELFDAISYSKG  480
               ++ L    +  +A DAL SSHP++    E+ TP++IS++FDAI+Y KG
Sbjct:    348  MEALF-GLVLQLALARDALGSSHPIT---VEVLTPSEISDIFDAITYEKG  393
```

The aminopeptidase-N (a/k/a APN, CD13, EC 3.4.11.2) disclosed herein as SEC7, is a well established marker of normal and malignant cells of the myelo-monocytic lineage. It is also expressed by leukaemic blasts of a small group of patients suffering from acute or chronic lymphoid leukaemia. CD13/aminopeptidase N (E.C.3.4.11.2) is an ectoenzyme located in the outermembrane. A soluble, non-cell-associated form of CD13/GP150/aminopeptidase-N localizable to plasma also exists.

The expression of the APN gene in T cell lines as well as the induction of APN gene and surface expression in human peripheral T cells by mitogenic activation have been demonstrated. For example, aminopeptidase expression was shown to be upregulated by a Th1-related cytokine, IFN-gamma. The induction of APN surface expression is partially resistent to the action of the inhibitors of protein biosynthesis, puromycin and cycloheximide, and is not prevented by tunicamycin, an inhibitor of glycosylation. The rapid mitogen-induced surface expression of APN, detectable 20 hours after stimulation, is dominated by mechanisms not dependent on de novo protein biosynthesis or glycosylation. Monocyte, granulocyte, and lymphocyte-enriched cell fractions possess aminopeptidase-N activity that is inhibitable by CD13 antibodies. Immunoaffinity isolation of plasma aminopeptidase-N has also been carried out; further characterization using functional studies and sodium dodecyl sulfate-polyacrylamide gel (SDS-PAGE) electrophoresis indicates that CD13 MABs can completely clear plasma of aminopeptidase-N activity and that the purified protein has similar electrophoretic characteristics to cell-derived material.

The activity of aminopeptidase in, for example, bronchoalveolar lavage fluid (BALF) was significantly higher in patients with sarcoidosis than in normal volunteers (NV) and control patients (CP). The activity significantly correlated with lymphocyte percentages and the ratio of CD4+ to CD8+ T lymphocytes in the BALF, and was higher in patients with sarcoidosis with parenchymal involvement than in those without the involvement. CD13/aminopeptidase N protein, which has a molecular mass of approximately 150 kD, was detectable in alveolar macrophages (AM) from patients with sarcoidosis at higher levels than in those from NV. CD13/aminopeptidase N induced in vitro chemotactic migration of human lymphocytes in a concentration range of 10(−)(5) to 10(−)(1) U/ml. The chemotactic activity was greater for CD4+ T lymphocytes than for CD8+ T lymphocytes. The enzymatic activity of CD13/aminopeptidase N was responsible for the chemotactic activity because bestatin, an inhibitor of CD13/aminopeptidase N, abolished the chemotactic activity. Higher chemotactic activity for lymphocytes was detected in the BALF from patients with sarcoidosis than in that from NV, and the activity was significantly decreased by treatment with bestatin. CD13/aminopeptidase N expressed in AM thus has a role in T-lymphocyte involvement in the sarcoid lung and the pathogenesis of alveolitis in this disorder and other disorders involving abberant cellular proliferation.

The SEC7 disclosed in this invention is expressed in at least the following tissues: apical microvilli of the retinal pigment epithelium, arterial (aortic), basal forebrain, brain, Burkitt lymphoma cell lines, corpus callosum, cardiac (atria and ventricle), caudate nucleus, CNS and peripheral tissue, cerebellum, cerebral cortex, colon, cortical neurogenic cells, endothelial (coronary artery and umbilical vein) cells, palate epithelia, eye, neonatal eye, frontal cortex, fetal hematopoietic cells, heart, hippocampus, hypothalamus, leukocytes, liver, fetal liver, lung, lung lymphoma cell lines, fetal lymphoid tissue, adult lymphoid tissue, those that express MHC I, II, and III, nervous tissues, medulla, subthalamic nucleus, ovary, pancreas, pituitary, placenta, pons, prostate, putamen, serum, skeletal muscle, small intestine, smooth muscle (coronary artery in aortia) spinal cord, spleen, stomach, taste receptor cells of the tongue, testis, thalamus, and thymus tissue. This information was derived by determining the tissue sources of the sequences that were included in the invention including but not limited to Seq-Calling sources, public EST sources, literature sources, and/or RACE sources. Further expression data for SEC7 is provided in Example 2.

The nucleic acids and proteins of SEC7 are useful in potential therapeutic applications implicated in various SEC-related pathological disorders described further herein. The SEC7 nucleic acid encoding the aminopeptidase-like protein of the invention, or fragments thereof, may further be useful in diagnostic applications, wherein the presence or amount of the nucleic acid or the protein are to be assessed.

These materials are further useful in the generation of antibodies that bind immunospecifically to the substances of the invention for use in therapeutic or diagnostic methods. These antibodies may be generated according to methods known in the art, using prediction from hydrophobicity charts, as described in the "Anti-SECX Antibodies" section below. The disclosed SEC7 protein has multiple hydrophilic regions, each of which can be used as an immunogen. In one embodiment, for example, a contemplated SEC7 epitope comprises from about amino acids 40 to about 120. In another embodiment, for example, a SEC7 epitope comprises from about amino acids 125 to about 275. In further embodiments, for example, a SEC7 epitope comprises from about 280 to about 310, from about 320 to about 420, from about 430 to about 460, from about 470 to about 480, from about 500 to about 650, from about 660 to about 850, and from about 860 to about 961.

SEC8

The disclosed SEC8 (alternatively referred to herein as CG56010-01) includes the 398 nucleotide sequence (SEQ ID NO:15) shown in Table 8A. A SEC8 ORF begins with a Kozak consensus ATG initiation codon at nucleotides 2–4 and ends with a TAG codon at nucleotides 224–226.

TABLE 8A

SEC8 NUCLEOTIDE SEQUENCE

GATGCTGGGGCTCCTCCTGGCCTTGCTGTCCTCCAGCTCTGCTGAGGAGTACGTGGGCCT (SEQ ID NO:15)

GTCTGCAAACCAGTGTGCCGTCCCGGCCAAGGACAGGGTGGACTGCGGCTACCCCCATGT

CACCCCCAAGGAGTGCAACAACCGGGGCTGCTGCTTTGACTCCAGGATCCCTGGAGTGCC

TTCGTGTTTCAAGCCCCTGACTAGGAAGACAGAATGCACCTTCTGAGGCACCTCCAGCTG

CCCCTGGGATGCAGGCTGAGCACCCTTGCCCCGGTGTGATTGCTGCCAGGCACTGTTCAT

CTCAGTTTTTCTGTCCCTTTGCTCCCGGCAAGCTTTCTGCTGAAAGTTCATATCTGGAGC

CTGATGTCTTAACGAATAAAGGTCCCATGCTCCACCCG

The SEC8 polypeptide (SEQ ID NO:16) encoded by SEQ ID NO:15 is 74 amino acids in length and is presented using the one-letter amino acid code in Table 8B. The Psort profile for SEC8 predicts that this sequence has a signal peptide and is likely to be secreted from the cell with a certainty of 0.3700. In alternative embodiments, a SEC8 polypeptide is located to the endoplasmic reticulum (lumen) with a certainty of 0.1000, to the endoplasmic reticulum (membrane) with a certainty of 0.1000, or to lysosomes with a certainty of 0.1000. The Signal P predicts a likely cleavage site for a SEC8 peptide is between positions 14 and 15, i.e., at the dash in the sequence SSA-EE.

TABLE 8B

SEC8 PROTEIN SEQUENCE

MLGLVLALLSSSSAEEYVGLSANQCAVPAKDRVDCGYPHVTPKECNNRGCCFDSRIPGVP (SEQ ID NO:16)

WCFKPLTRKTECTF

A BLAST analysis of SEC8 was run against the proprietary PatP GENESEQ Protein Patent database. It was found, for example, that the amino acid sequence of SEC8 had high homology to other proteins as shown in Table 8C.

TABLE 8C

BLASTX results from PatP database for SEC8

| Sequences producing High-scoring Segment Pairs: | High Score | Smallest Sum Probability P(N) |
|---|---|---|
| patp: AAR26876 Human intestinal trefoil factor | 412 | 2.7e−38 |
| patp: AAW27631 Human intestinal trefoil factor (hITF) | 412 | 2.7e−38 |
| patp: AAY99888 Human intestinal trefoil factor | 412 | 2.7e−38 |

TABLE 8C-continued

BLASTX results from PatP database for SEC8

| Sequences producing High-scoring Segment Pairs: | High Score | Smallest Sum Probability P(N) |
|---|---|---|
| patp: AAW06550 Human colon specific gene CSG8 | 399 | 6.5e−37 |
| patp: AAW46882 Protein sequence | 399 | 6.5e−37 |

In a search of public sequence databases, it was found, for example, that the amino acid sequence of the SEC8 protein of the present invention was found to have 74 of 74 amino acid residues (100%) identical to the 74 amino acid NM_003226. SEC8 also has homology to the proteins shown in the BLASTP data in Table 8D.

TABLE 8D

SEC8 BLASTP results

| Gene Index/Identifier | Protein/Organism | Length (aa) | Identity (%) | Positive (%) | Expect |
|---|---|---|---|---|---|
| gi\|4507453\|ref\|NP_003217.1\| (NM_003226) | trefoil factor 3 (intestinal); trefoil factor 3, HITF, human | 74 | 74/74 (100) | 74/74 (100) | 3e−27 |

TABLE 8D-continued

SEC8 BLASTP results

| Gene Index/Identifier | Protein/Organism | Length (aa) | Identity (%) | Positive (%) | Expect |
|---|---|---|---|---|---|
| gi\|385570\|gb\|AAB27021.1\| | intestinal trefoil factor [*Homo sapiens*] trefoil factor [human, intestine, Peptide Partial, 61 aa] | 61 | 61/61 (100) | 61/61 (100) | 1e−26 |
| gi\|7768743\|dbj\|BAA95531.1\| (AP001746) | trefoil factor 3, HITF, human intestinal trefoil | 74 | 70/74 (94) | 72/74 (96) | 3e−24 |
| gi\|17461336\|ref\|XP_032969.2\| (XM_032969) | trefoil factor 3 (intestinal) [*Homo sapiens*] | 80 | 70/74 (94) | 72/74 (96) | 5e−24 |
| gi\|12084578\|pdb\|1E9T\|A | Chain A, High Resolution Solution Structure Of Human Intestinal | 59 | 55/59 (93) | 57/59 (96) | 1e−22 |

This BLASTP data is displayed graphically in the ClustalW in Table 8E. A multiple sequence alignment is given in Table 8E, with the SEC8 protein being shown on line 1, in a ClustalW analysis comparing the protein of the invention with the related protein sequences shown in Table 8D.

Reverse Position Specific BLAST analyses. This BLAST analysis software samples domains found in the Smart and Pfam collections. Fully conserved single residues are indicated by the sign (|) and "strong" semi-conserved residues are indicated by the sign (+). The "strong" group of con-

TABLE 8E

```
                ClustalW Alignment of SEC8

1) SEC8          (SEQ ID NO:16)
2) gi|4507453|   (SEQ ID NO:76)
3) gi|385570|    (SEQ ID NO:77)
4) gi|7768743|   (SEQ ID NO:78)
5) gi|17461336|  (SEQ ID NO:79)
6) gi|12084578|  (SEQ ID NO:80)

10        20        30        40        50
              ....|....|....|....|....|....|....|....|....|....|
SEC8          -------MLGLVLALLSSSSAEEYVGLSANQCAVPAKDRVDCGYPHVTPK
gi|4507453|   -------MLGLVLALLSSSSAEEYVGLSANQCAVPAKDRVDCGYPHVTPK
gi|385570|    ---------------------AEEYVGLSANQCAVPAKDRVDCGYPHVTPK
gi|7768743|   -------MLGLVLALLSSSSAEEYVGLSANQCAVPAKDRVDCGYPHVTPK
gi|17461336|  MAARALCMLGLVLALLSSSSAEEYVGLSANQCAVPAKDRVDCGYPHVTPK
gi|12084578|  --------------------XEYVGLSANQCAVPAKDRVDCGYPHVTPK 60        70        80
              ....|....|....|....|....|....|..
SEC8          ECNNRGCCFDSRIPGVPWCFKPLTRKTECTF
gi|4507453|   ECNNRGCCFDSRIPGVPWCFKPLTRKTECTF
gi|385570|    ECNNRGCCFDSRIPGVPWCFKPLTRKTECTF
gi|7768743|   ECNNRGCCFDSRIPGVPWCFKPLQ-EAECTF
gi|17461336|  ECNNRGCCFDSRIPGVPWCFKPLQ-EAECTF
gi|12084578|  ECNNRGCCFDSRIPGVPWCFKPLQ-EAECTF
```

The presence of identifiable domains in SEC8, as well as all other SECX proteins, was determined by searches using software algorithms such as PROSITE, DOMAIN, Blocks, Pfam, ProDomain, and Prints, and then determining the Interpro number by crossing the domain match (or numbers) using the Interpro website (http:www.ebi.ac.uk/interpro). DOMAIN results for SEC8 as disclosed in Table 8F, were collected from the Conserved Domain Database (CDD) with served amino acid residues may be any one of the following groups of amino acids: STA, NEQK, NHQK, NDEQ, QHRK, MILV, MILF, HY, FYW.

Table 8F lists the domain description from DOMAIN analysis results against SEC8. This indicates that the SEC8 sequence has properties similar to those of other proteins known to contain this domain.

TABLE 8F

DOMAIN ANALYSIS OF SEC8 gnl|Smart'smart00018, P, P or trefoil or TFF domain; Proposed role in renewal and pathology of mucous epithelia.
CD-Length = 47 residues, 95.7% aligned
Score = 62.4 bits (150), Expect = 9e−12

TABLE 8F-continued

DOMAIN ANALYSIS OF SEC8

```
SEC 8:  23 NQCAVPAKDRVDCGYPHVTPKECNNRGCCFDSRIPGVPWCFKPLT  67  (SEQ ID NO:302)
           QC+VP  +R++CG P +T  EC  RGCCFDS I GVPWCF P T
Sbjct:   1 FQCSVPPSERINCGPPGITEAECEARGCCFDSSISGVPWCFYPNT  45
```

TFF-peptides (i.e. TFF1, TFF2, TFF3; formerly P-domain peptides, trefoil factors) have been established as secretory products typical of mucin-producing epithelial cells, for example, the respiratory tract, the salivary glands, the uterus, and the conjunctiva. TFF-peptides have a pivotal role in maintaining the surface integrity of these delicate epithelia as constituents of mucus gels as well as by their anti-apoptotic properties and their motogenic activity modulating cell migratory processes. Mucin-associated TFF-peptides (formerly P-domain peptides or trefoil factors) are typical motogens enhancing migration of cells in various in vitro models mimicking restitution of the intestine.

One of these peptides, TFF3, disclosed herein as SEC8 has been detected as a new neuropeptide of the human hypothalamo-pituitary axis where it is synthesized in oxytocinergic neurons of the paraventricular and supraoptic nuclei. From there it is transported to the posterior pituitary where it is released into the blood stream. Promoter methylation analyses showed that, in tissues where these genes are normally expressed, the proximal promoters of TFF1 and TFF2 are specifically not methylated and that of TFF3 is partially demethylated. In contrast, in organs that do not express TFFs, the promoters of the three genes are methylated. These findings strongly argue for the involvement of epigenetic mechanisms in the regulation of TFF expression in normal and pathological conditions. In addition, TFF3 demonstrates anti-anoikic properties. TFF3 activates NF-kappaB in enterocytes, and TFF3-induced resistance to anoikis in intestinal epithelial cells is mediated by a distinct signaling cascade linked to NF-kappaB.

Trefoil peptides are abundantly expressed epithelial cell products which exert protective effects and are key regulators of gastrointestinal epithelial restitution, the critical early phase of cell migration after mucosal injury. TFF-peptides act as motogens in the human respiratory epithelium triggering rapid repair of damaged mucosa in the course of airway diseases such as asthma. Synthesis of TFF-peptides also occurs pathologically as result to chronic inflammatory diseases, for example of the gastrointestinal tract. Aberrant synthesis of TFF-peptides is observed in many tumors, for example, TTF is induced in human intestinal metaplasia and conserved in all gastric cancers.

The SEC8 disclosed in this invention is expressed in at least the following tissues: apical microvilli of the retinal pigment epithelium, arterial (aortic), basal forebrain, brain, Burkitt lymphoma cell lines, corpus callosum, cardiac (atria and ventricle), caudate nucleus, CNS and peripheral tissue, cerebellum, cerebral cortex, colon, cortical neurogenic cells, endothelial (coronary artery and umbilical vein) cells, palate epithelia, eye, neonatal eye, frontal cortex, fetal hematopoietic cells, heart, hippocampus, hypothalamus, leukocytes, liver, fetal liver, lung, lung lymphoma cell lines, fetal lymphoid tissue, adult lymphoid tissue, those that express MHC I, II, and III, nervous tissues, medulla, subthalamic nucleus, ovary, pancreas, pituitary, placenta, pons, prostate, putamen, serum, skeletal muscle, small intestine, smooth muscle (coronary artery in aortia) spinal cord, spleen, stomach, taste receptor cells of the tongue, testis, thalamus, and thymus tissue. This information was derived by determining the tissue sources of the sequences that were included in the invention including but not limited to Seq-Calling sources, public EST sources, literature sources, and/or RACE sources. Further expression data for SEC8 is provided in Example 2.

The nucleic acids and proteins of SEC8 are useful in potential therapeutic applications implicated in various SEC-related pathological disorders described further herein. The SEC8 nucleic acid encoding the TFF-like protein of the invention, or fragments thereof, may further be useful in diagnostic applications, wherein the presence or amount of the nucleic acid or the protein are to be assessed.

These materials are further useful in the generation of antibodies that bind immunospecifically to the substances of the invention for use in therapeutic or diagnostic methods. These antibodies may be generated according to methods known in the art, using prediction from hydrophobicity charts, as described in the "Anti-SECX Antibodies" section below. The disclosed SEC8 protein has multiple hydrophilic regions, each of which can be used as an immunogen. In one embodiment, for example, a contemplated SEC8 epitope comprises from about amino acids 20 to about 65.

SEC9

The disclosed SEC9 (alternatively referred to herein as CG56162-01) includes the 1192 nucleotide sequence (SEQ ID NO:17) shown in Table 9A. A SEC9 ORF begins with a Kozak consensus ATG initiation codon at nucleotides 151–153 and ends with a TGA codon at nucleotides 1091–1093.

TABLE 9A

SEC9 NUCLEOTIDE SEQUENCE

CCAGCCCGAAAGGCAGGGTCTGGGTGCGGGAAGAGGGCTCGGAGCTGCCTTCCTGCTGCC (SEQ ID NO:17)

TTGGGGCCGCCCAGATGAGGGAACAGCCCGATTTGCCTGGTTCTGATTCTCCAGGCTGTC

GTGGTTGTGGAATGCAAACGCCAGCACATAATGGAAACAGGACCTGAAGACCCTTCCAGC

ATGCCAGAGGAAAGTTCCCCCAGGCGGACCCCGCAGAGCATTCCCTACCAGGACCTCCCT

CACCTGGTCAATGCAGACGGACAGTACCTCTTCTGCAGGTACTGGAAACCCACAGGCACA

CCCAAGGCCCTCATCTTTGTGTCCCATGGAGCCGGAGAGCACAGTGGCCGCTATGAAGAG

CTGGCTCGGATGCTGATGGGGCTGGACCTGCTGGTGTTCGCCCACGACCATGTTGGCCAC

GGACAGAGCGAAGGGGAGAGGATGGTAGTGTCTGACTTCCACGTTTTCGTCAGGGATGTG

TTGCAGCATGTGGATTCCATGCAGAAAGACTACCCTGGGCTTCCTGTCTTCCTTCTGGGC

CACTCCATGGGAGGCGCCATCGCCATCCTCACGGCCGCAGAGAGGCCGGGCCACTTCGCC

GGCATGGTACTCATTTCGCCTCTGGTTCTTGCCAATCCTGAATCTGCAACAACTTTCAAG

GTCCTTGCTGCGAAAGTGCTCAACCTTGTGCTGCCAAACTTGTCCCTCGGGCCCATCGAC

TCCAGCGTGCTCTCTCGGAATAAGACAGAGGTCGACATTTATAACTCAGACCCCCTGATC

TGCCGGGCAGGGCTGAAGGTGTGCTTCGGCATCCAACTGCTGAATGCCGTCTCACGGGTG

GAGCGCGCCCTCCCCAAGCTGACTGTGCCCTTCCTGCTGCTCCAGGGCTCTGCCGATCGC

CTATGTGACAGCAAAGGGGCCTACCTGCTCATGGAGTTAGCCAAGAGCCAGGACAAGACT

CTCAAGATTTATGAAGGTGCCTACCATGTTCTCCACAAGGAGCTTCCTGAAGTCACCAAC

TCCGTCTTCCATGAAATAAACATGTGGGTCTCTCAAAGGACAGCCACGGCAGGAACTGCG

TCCCCACCCTGAATGCATTGGCCGGTGCCCGGCTCATGGTCTGGGGGATGCAGGCAGGGG

AAGGGCAGAGATGGCTTCTCAGATATGGCTTGCAAAAAAAAAAAAAAAAAAA

The SEC9 polypeptide (SEQ ID NO:18) encoded by SEQ ID NO:17 is 313 amino acids in length and is presented using the one-letter amino acid code in Table 9B. The Psort profile for SEC9 predicts that this sequence is likely to be localized at the cytoplasm with a certainty of 0.6500. In alternative embodiments, a SEC9 polypeptide is located to lysosomes (lumen) with a certainty of 0.1971, or to the mitochondrial matrix space with a certainty of 0.1000.

TABLE 9B

SEC9 PROTEIN SEQUENCE

METGPEDPSSMPEESSPRRTPQSIPYQDLPHLVNADGQYLFCRYWKPTGTPKALIFVSHG (SEQ ID NO:18)

AGEHSGRYEELARMLMGLDLLVFAHDHVGHGQSEGERMVVSDFHVFVRDVLQHVDSMQKD

YPGLPVFLLGHSMGGAIAILTAAERPGHFAGMVLISPLVLANPESATTFKVLAAKVLNLV

LPNLSLGPIDSSVLSRNKTEVDIYNSDPLICRAGLKVCFGIQLLNAVSRVERALPKLTVP

FLLLQGSADRLCDSKGAYLLMELAKSQDKTLKIYEGAYHVLHKELPEVTNSVFHEINMWV

SQRTATAGTASPP

A BLAST analysis of SEC9 was run against the proprietary PatP GENESEQ Protein Patent database. It was found, for example, that the amino acid sequence of SEC9 had high homology to other proteins as shown in Table 9C.

TABLE 9C

BLASTX results from PatP database for SEC9

| Sequences producing High-scoring Segment Pairs: | High Score | Smallest Sum Probability P(N) |
|---|---|---|
| patp: AAG10768 Arabidopsis thaliana protein fragment | 343 | 5.6e−31 |
| patp: AAG10769 Arabidopsis thaliana protein fragment | 343 | 5.6e−31 |
| patp: AAG10770 Arabidopsis thaliana protein fragment | 343 | 5.6e−31 |

TABLE 9C-continued

BLASTX results from PatP database for SEC9

| Sequences producing High-scoring Segment Pairs: | High Score | Smallest Sum Probability P(N) |
|---|---|---|
| patp: AAB96388 Putative P. abyssi lysophospholipase | 326 | 3.5e−29 |
| patp: AAW23073 Thermococcus esterase CL-2-30LC | 319 | 1.9e−28 |

In a search of public sequence databases, it was found, for example, that the amino acid sequence of the SEC9 protein of the present invention was found to have 313 of 313 amino acid residues (100%) identical to the 313 amino acid NM_007283. SEC9 also has homology to the other proteins shown in the BLASTP data in Table 9D.

TABLE 9D

SEC9 BLASTP results

| Gene Index/Identifier | Protein/Organism | Length (aa) | Identity (%) | Positives (%) | Expect |
|---|---|---|---|---|---|
| gi\|6005786\|ref\|NP_009214.1\| (NM_007283) | monoglyceride lipase; lysophospholipase-like; | 313 | 313/313/ (100) | 313/313 (100) | e−179 |
| gi\|17440844\|ref\|XP_042586.2\| (XM_042586) | lysophospholipase-like [Homo sapiens] | 303 | 303/303 (100) | 303/303 (100) | e−174 |
| gi\|6754690\|ref\|NP_035974.1\| (NM_011844) | monoglyceride lipase [Mus musculus] | 303 | 255/303 (84) | 283/303 (93) | e−152 |
| gi\|2145125\|gb\|AAB58421.1\| (U67964) | H14-E [Ectromelia virus] | 277 | 132/272 (48) | 184/272 (67) | 1e−75 |
| gi\|17974944\|ref\|NP_536458.1\| (NC_003310) | C5L [Monkeypox virus] | 274 | 130/272 (47) | 182/272 (66) | 6e−74 |

This BLASTP data is displayed graphically in the ClustalW in Table 9E. A multiple sequence alignment is given in Table 9E, with the SEC9 protein being shown on line 1, in a ClustalW analysis comparing the protein of the invention with the related protein sequences shown in Table 9D.

TABLE 9E

ClustalW Alignment of SEC9

```
1) SEC9          (SEQ ID NO:18)
2) gi|6005786|   (SEQ ID NO:81)
3) gi|17440844|  (SEQ ID NO:82)
4) gi|6754690|   (SEQ ID NO:83)
5) gi|2145125|   (SEQ ID NO:84)
6) gi|17974944|  (SEQ ID NO:85)

10        20        30        40        50
                 ....|....|....|....|....|....|....|....|....|....|
SEC9             METGPEDPSSMPEESSPRRTPQSIPYQDLPHLVNADGQYLFCRYWKPTGT
gi|6005786|      METGPEDPSSMPEESSPRRTPQSIPYQDLPHLVNADGQYLFCRYWKPTGT
gi|17440844|     ----------MPEESSPRRTPQSIPYQDLPHLVNADGQYLFCRYWKPTGT
gi|6754690|      ----------MPEASSPRRTPQNVPYQDLPHLVNADGQYLFCRYWKPSGT
gi|2145125|      ---------------MSAN------------CMFNLDNDYIYCKYWKPITY
gi|17974944|     ---------------MSAN------------CMFNLDNDYIYCKYWKPITY
```

TABLE 9E-continued

ClustalW Alignment of SEC9

```
                  60         70         80         90        100
              ....|....|....|....|....|....|....|....|....|....|
SEC9          PKALIFVSHGAGEHSGRYEELARMLMGLDELVFAHDHVGHGQSEGERMVV
gi|6005786|   PKALIFVSHGAGEHSGRYEELARMLMGLDELVFAHDHVGHGQSEGERMVV
gi|17440844|  PKALIFVSHGAGEHSGRYEELARMLMGLDELVFAHDHVGHGQSEGERMVV
gi|6754690|   PKALIFVSHGAGEHCGRYEELAHMLKGLDMLVFAHDHVGHGQSEGERMVV
gi|2145125|   PKALVFISHGAGEHSGRYDELAENISSLGILVFSHDHTGHGRSNGEKMMI
gi|17974944|  PKALVFISHGAGEHSGRYDELAENISSLGILVFSHDHIGHGRSNGEKMMI 110        120        130        140        150
              ....|....|....|....|....|....|....|....|....|....|
SEC9          SDFHVFVRDVLQHVDSMQKDYPGLPVFLLGHSMGGAIAILTAAERPGHEA
gi|6005786|   SDFHVFVRDVLQHVDSMQKDYPGLPVFLLGHSMGGAIAILTAAERPGHEA
gi|17440844|  SDFHVFVRDVLQHVDSMQKDYPGLPVFLLGHSMGGAIAILTAAERPGHEA
gi|6754690|   SDFQVFVRDVLQHVDTIQKDYPDVPIFLLGHSMGGAISILVAAERPTYES
gi|2145125|   DDEGTYVRDVVQHVVTIKSTYPGVPVFLLGHSMGATISILAAYENPNLET
gi|17974944|  DDEGTYVRDVVQHVVTIKSTYPGVPVFLLGHSMGATISILAACDNPNLET 160        170        180        190        200
              ....|....|....|....|....|....|....|....|....|....|
SEC9          GMVLISPLVLANPESATTFKVLAAKVLNLVLPNLSLGPIDSSVLSRNKTE
gi|6005786|   GMVLISPLVLANPESATTFKVLAAKVLNLVLPNLSLGPIDSSVLSRNKTE
gi|17440844|  GMVLISPLVLANPESATTFKVLAAKVLNLVLPNLSLGPIDSSVLSRNKTE
gi|6754690|   GMVLISPLVLANPESASILKVLAAKLLNFVLPNMTLGRIDSSVLSRNKSE
gi|2145125|   AMILMSPLVNAD--AVPRLNLLAAKLMGTITPNVSVGKLCPESVSRDKDE
gi|17974944|  AMILMSPLVNAD--AVPRLNLLAAKLMGTITPNASVGKLCPESVSRDMDE 210        220        230        240        250
              ....|....|....|....|....|....|....|....|....|....|
SEC9          VDIYNSDPLICRAGLKVCFGIQLLNAVSRVERALPKLTVPFLLLQGSADR
gi|6005786|   VDIYNSDPLICRAGLKVCFGIQLLNAVSRVERALPKLTVPFLLLQGSADR
gi|17440844|  VDIYNSDPLICRAGLKVCFGIQLLNAVSRVERALPKLTVPFLLLQGSADR
gi|6754690|   VDIYNSDPLVCRAGLKVCFGIQLLNAVARVERAMPRLILPFLLLQGSADR
gi|2145125|   VYKYQYDPLVNHEKIKAGEASQVLKATNKVRKIIPKINTPTLILQGINNE
gi|17974944|  VYKYQYDPLVNHEKIKAGEASQVLKATNKVRKIIPKIDTPTLILQGINNE 260        270        280        290        300
              ....|....|....|....|....|....|....|....|....|....|
SEC9          LCDSKGAYLLMELAKSQDKTLKIYEGAYHVLHKELPEVTNSVFHEINMWV
gi|6005786|   LCDSKGAYLLMELAKSQDKTLKIYEGAYHVLHKELPEVTNSVFHEINMWV
gi|17440844|  LCDSKGAYLLMELAKSQDKTLKIYEGAYHVLHKELPEVTNSVFHEINMWV
gi|6754690|   LCDSKGAYLLMESSRSQDKTLKMYEGAYHVLHRELPEVTNSVLHEVNSWV
gi|2145125|   ISDVSGAYYFMQHANCN-REIKIYEGAKHHLHKETDEVKKSVMKEIETWI
gi|17974944|  ISDVSGAYYFMQHANCN-REIKIYEGAKHHLHKETDEVKKSVMKEIETWI

310
              ....|....|
SEC9          SQRIATAGTASPP
gi|6005786|   SQRIATAGTASPP
gi|17440844|  SQRIATAGTASPP
gi|6754690|   SHRIAAAGAGCPP
gi|2145125|   FNRVKL-------
gi|17974944|  FNRVK--------
```

The presence of identifiable domains in SEC9, as well as all other SECX proteins, was determined by searches using software algorithms such as PROSITE, DOMAIN, Blocks, Pfam, ProDomain, and Prints, and then determining the Interpro number by crossing the domain match (or numbers) using the Interpro website (http:www.ebi.ac.uk/interpro). DOMAIN results for SEC9 as disclosed in Table 9F, were collected from the Conserved Domain Database (CDD) with Reverse Position Specific BLAST analyses. This BLAST analysis software samples domains found in the Smart and Pfam collections. Fully conserved single residues are indicated by the sign (|) and "strong" semi-conserved residues are indicated by the sign (+). The "strong" group of conserved amino acid residues may be any one of the following groups of amino acids: STA, NEQK, NHQK, NDEQ, QHRK, MILV, MILF, HY, FYW.

Table 9F lists the domain description from DOMAIN analysis results against SEC9. This indicates that the SEC9 sequence has properties similar to those of other proteins known to contain this domain.

TABLE 9F

Domain Analysis of SEC9

```
gnl|Pfam|pfam00561, abhydrolase, alpha/beta hydrolase fold. This catalytic
domain is found in a very wide range of enzymes. Sbjct: (SEQ ID NO: 303)
CD-Length=226 residues, 99.1% aligned
Score=63.9 bits (154), Expect=1e-11

SEC 9:    82  VFAHDHVGHGQSEGERMVVSDFHVFVRDVLQHVDSMQKDYPGLPVFLLGHSMGGAIAILT  141
              V    D  G GQS    +    F    D+   +D++    D         V L+GHSMGGAIA
Sbjct:     3  VILFDLRGFGQSSPSDLAEYRFDDLAEDLEALLDALGLD----KVILVGHSMGGAIAAAY  58
```

TABLE 9F-continued

Domain Analysis of SEC9

```
SEC 9:  142 AAERPGHFAGMVLISP---LVLANPE-----------SATTFKVLAAKVLNLVLPNLSLG 187
            AA+ P      +VL+S     +L++              +     + + + L
Sbjct:   59 AAKYPERVKALVLVSAPHPALLSSRLFPRNLFGLLLANFRNRLLRSVEALLGRALKQFFL 118

SEC 9:  188 PIDSSVLSRNKTEVDIYNSDPLICRAGLKVCFGIQLLNAVSRVERALPKLTVPFLLLQGS 247
                   V   K              G   + +         V   L ++ VP L++ G
Sbjct:  119 LGRPLVSDFLKQFELSSLIRFGEDDGGDGLLWVALGKLLQWDVSADLKRIKVPTLVIWGD 178

SEC 9:  248 ADRLCDSKGAYLLMELAKSQDKTLKIYEGAYHVLHKELPEVTNSVFHEINMWV 300
               D L   + L L +    + + + A H+   E PE   V   I  ++
Sbjct:  179 DDPLVPPDASEKLSALFPNA--EVVVIDDAGHLAQLEKPEE---VAELILKFL 226
```

Lysophospholipase, disclosed herein as SEC9, is a critical enzyme that acta on biological membranes to regulate the multifunctional lysophospholipids. Increased levels of lysophospholipids are associated with a host of diseases. Low activity of key phospholipid catabolic and anabolic enzymes in human substantia nigra results in reduced ability to repair oxidative membrane damage, as may occur, for example, in Parkinson's disease and Alzheimer's disease. Lysophospholipase is a major autocrystallizing constituent of human eosinophils and basophils, comprising approximately 10% of the total cellular protein in these granulocytes. Identification of the distinctive hexagonal bipyramidal crystals of CLC protein in body fluids and secretions has long been considered a hallmark of eosinophil-associated allergic inflammation. The compositions for and methods of modulating lysophospholipase has utility in the prevention and treatment of allergic diseases and inflammation.

The SEC9 disclosed in this invention is expressed in at least the following tissues: apical microvilli of the retinal pigment epithelium, arterial (aortic), basal forebrain, brain, Burkitt lymphoma cell lines, corpus callosum, cardiac (atria and ventricle), caudate nucleus, CNS and peripheral tissue, cerebellum, cerebral cortex, colon, cortical neurogenic cells, endothelial (coronary artery and umbilical vein) cells, palate epithelia, eye, neonatal eye, frontal cortex, fetal hematopoietic cells, heart, hippocampus, hypothalamus, leukocytes, liver, fetal liver, lung, lung lymphoma cell lines, fetal lymphoid tissue, adult lymphoid tissue, those that express MHC I, II, and III, nervous tissues, medulla, subthalamic nucleus, ovary, pancreas, pituitary, placenta, pons, prostate, putamen, serum, skeletal muscle, small intestine, smooth muscle (coronary artery in aortia) spinal cord, spleen, stomach, taste receptor cells of the tongue, testis, thalamus, and thymus tissue. This information was derived by determining the tissue sources of the sequences that were included in the invention including but not limited to Seq-Calling sources, public EST sources, literature sources, and/or RACE sources. Further expression data for SEC9 is provided in Example 2.

The nucleic acids and proteins of SEC9 are useful in potential therapeutic applications implicated in various SEC-related pathological disorders described further herein. The SEC9 nucleic acid encoding the lysophospholipase-like protein of the invention, or fragments thereof, may further be useful in diagnostic applications, wherein the presence or amount of the nucleic acid or the protein are to be assessed.

These materials are further useful in the generation of antibodies that bind immunospecifically to the substances of the invention for use in therapeutic or diagnostic methods. These antibodies may be generated according to methods known in the art, using prediction from hydrophobicity charts, as described in the "Anti-SECX Antibodies" section below. The disclosed SEC9 protein has multiple hydrophilic regions, each of which can be used as an immunogen. In one embodiment, for example, a contemplated SEC9 epitope comprises from about amino acids 10 to about 50. In another embodiment, for example, a SEC9 epitope comprises from about amino acids 55 to about 75. In further embodiments, for example, a SEC9 epitope comprises from about 90 to about 105, from about 110 to about 130, from about 180 to about 210, and from about 250 to about 313.

SEC10

The disclosed SEC10 (alternatively referred to herein as CG56164-01) includes the 1104 nucleotide sequence (SEQ ID NO:19) shown in Table 10A. A SEC10 ORF begins with a Kozak consensus ATG initiation codon at nucleotides 47–49 and ends with a TAG codon at nucleotides 983–985. The disclosed SEC10 maps to human chromosome 17.

TABLE 10A

SEC10 Nucleotide Sequence

CTCGGTGCGCGACCCCGGCTCAGAGGACTCTTTGCTGTCCCGCAAGATGCGGATGCTGCT (SEQ ID NO:19)
GGCGCTCCTGGCCCTCTCCGCGGCGCGGCCATCGGCCAGTGCAGAGTCACACTGGTGCTA

TABLE 10A-continued

SEC10 Nucleotide Sequence

```
CGAGGTTCAAGCCGAGTCCTCCAACTACCCCTGCTTGGTGCCAGTCAAGTGGGGTGGAAA

CTGCCAGAAGGACCGCCAGTCCCCCATCAACATCGTCACCACCAAGGCAAAGGTGGACAA

AAAACTGGGACGCTTCTTCTTCTCTGGCTACGATAAGAAGCAAACGTGGACTGTCCAAAA

TAACGGGCACTCAGTGATGATGTTGCTGGAGAACAAGGCCAGCATTTCTGGAGGAGGACT

GCCTGCCCCATACCAGGCCAAACAGTTGCACCTGCACTGGTCCGACTTGCCATATAAGGG

CTCGGAGCACAGCCTCGATGGGGAGCACTTTGCCATGGAGATGCACATAGTACATGAGAA

AGAGAAGGGGACATGGACGAATGTCAAAGAGGCCCAGGACCCTGAAGACGAAATTGCGGT

GCTGGCCTTTCTGGTGGAGGCTGGAACCCAGGTGAACGAGGGCTTCCAGCCACTGGTGGA

GGCACTGTCTAATATCCCCAAACCTGAGATGAGCACTACGATGGCAGAGAGCAGCCTGTT

GGACCTGCTCCCCAAGGAGGAGAAACTGAGGCACTACTTCCGCTACCTGGGCTCACTCAC

CACACCGACCTGCGATGAGAAGGTCGTCTGGACTGTGTTCCGGGAGCCCATTCAGCTTCA

CAGAGAACAGATCCTGGCATTCTCTCAGAAGCTGTACTACGACAAGGAACAGACAGTGAG

CATGAAGGACAATGTCAGGCCCCTGCAGCAGCTGGGGCAGCGCACGGTGATAAAGTCCGG

GGCCCCGGGTCGGCCGCTGCCCTGGGCCCTGCCTGCCCTGCTGGGCCCCATGCTGGCCTG

CCTGCTGGCCGGCTTCCTGCGATGATGGCTCACTTCTGCACGCAGCCTCTCTGTTGCCTC

AGCTCTCCAAGTTCCAGGCTTCCGGTCCTTAGCCTTCCCAGGTGGGACTTTAGGCATGAT

TAAAATATGGACATATTTTTGGAG
```

The SEC10 polypeptide (SEQ ID NO:20) encoded by SEQ ID NO:19 is 312 amino acids in length and is presented using the one-letter amino acid code in Table 10B. The Psort profile for SEC10 predicts that this sequence has a signal peptide and is likely to be localized at the plasma membrane with a certainty of 0.9190. In alternative embodiments, a SEC10 polypeptide is located to lysosomal membranes with a certainty of 0.2000, to the endoplasmic reticulum (membrane) with a certainty of 0.1000, or to the endoplasmic reticulum (lumen) with a certainty of 0.1000. The Signal P predicts a likely cleavage site for a SEC10 peptide is between positions 19 and 20, i.e., at the dash in the sequence ASA-ES.

A BLAST analysis of SEC10 was run against the proprietary PatP GENESEQ Protein Patent database. It was found, for example, that the amino acid sequence of SEC10 had high homology to other proteins as shown in Table 10C.

TABLE 10C

BLASTX results from PatP database for SEC10

| Sequences producing High-scoring Segment Pairs: | High Score | Smallest Sum Probability P(N) |
|---|---|---|
| patp: AAB59591 Human carbonic anhydrase isoform #4 | 1420 | 4.2e–145 |

TABLE 10B

SEC10 protein sequence

MRMLLALLALSAARPSASAESHWCYEVQAESSNYPCLVPVKWGGNCQKDRQSPINIVTTK  (SEQ ID NO:20)

AKVDKKLGRFFFSGYDKKQTWTVQNNGHSVMMLLENKASISGGGLPAPYQAKQLHLHWSD

LPYKGSEHSLDGEHFAMEMHIVHEKEKGTSRNVKEAQDPEDEIAVLAFLVEAGTQVNEGF

QPLVEALSNIPKPEMSTTMAESSLLDLLPKEEKLRHYFRYLGSLTTPTCDEKVVWTVFRE

PIQLHREQILAFSQKLYYDKEQTVSMKDNVRPLQQLGQRTVIKSGAPGRPLPWALPALLG

PMLACLLAGFLR

TABLE 10C-continued

BLASTX results from PatP database for SEC10

| Sequences producing High-scoring Segment Pairs: | High Score | Smallest Sum Probability P(N) |
|---|---|---|
| patp: AAB54035 Human pancreatic cancer antigen | 704 | 3.1e-69 |
| patp: AAR91950 Lung cancer specific antigen HCAVIII | 376 | 1.8e-34 |
| patp: AAY96200 Non-small cell lung carcinoma cell antigen | 376 | 1.8e-34 |
| patp: AAY99460 Human PRO1335 amino acid sequence | 376 | 1.8e-34 |

In a search of public sequence databases, it was found, for example, that the amino acid sequence of the SEC10 protein of the present invention was found to have 312 of 312 amino acid residues (100%) identical to the 312 amino acid NM_000717. SEC10 also has homology to the other proteins shown in the BLASTP data in Table 10D.

TABLE 10D

SEC10 BLASTP results

| Gene Index/Identifier | Protein/Organism | Length (aa) | Identity (%) | Positive (%) | Expect |
|---|---|---|---|---|---|
| gi\|4502519\|ref\|NP_000708.1\| (NM_000717) | carbonic anhydrase IV precursor; carbonic dehydratase [Homo sapiens] | 312 | 312/312 (100) | 312/312 (100) | e-175 |
| gi\|409725\|gb\|AAA35625.1\| (L10955) | carbonic anhydrase IV [Homo sapiens] | 294 | 294/312 (94) | 294/312 (94) | e-160 |
| gi\|2554743\|pdb\|1ZNC\|A | Chain A, Human Carbonic Anhydrase IV | 266 | 266/266 (100) | 266/266 (100) | e-155 |
| gi\|2134864\|pir\|S66253 | carbonate dehydratase (EC 4.2.1.1) IV - human (fragments) | 262 | 262/265 (98) | 262/265 (98) | e-151 |
| gi\|17478944\|ref\|XP_008313.6\| (XM_008313) | carbonic anhydrase IV precursor [Homo sapiens] | 335 | 232/234 (99) | 232/234 (99) | e-128 |

This BLASTP data is displayed graphically in the ClustalW in Table 10E. A multiple sequence alignment is given in Table 10E, with the SEC10 protein being shown on line 1, in a ClustalW analysis comparing the protein of the invention with the related protein sequences shown in Table 10D.

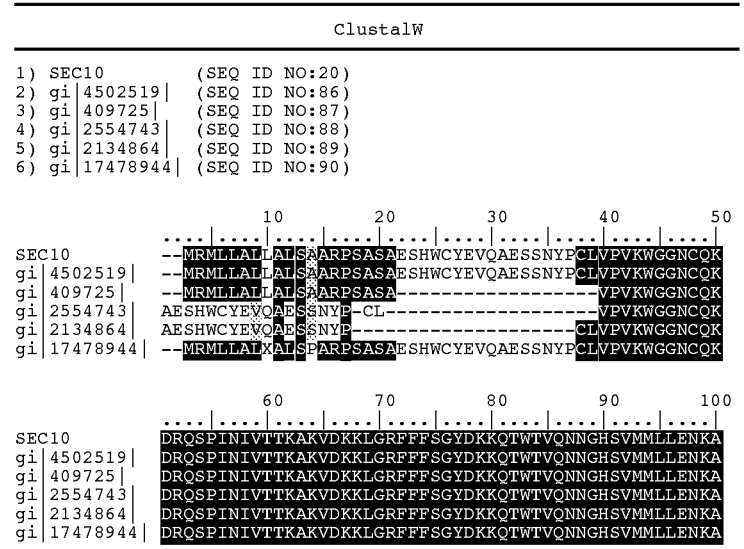

TABLE 10E

TABLE 10E-continued

ClustalW

```
              110       120       130       140       150
         ....|....|....|....|....|....|....|....|....|....|
SEC10        SISGGGLPAPYQAKQLHLHWSDLPYKGSEHSLDGEHFAMEMHIVHEKEKG
gi|4502519|  SISGGGLPAPYQAKQLHLHWSDLPYKGSEHSLDGEHFAMEMHIVHEKEKG
gi|409725|   SISGGGLPAPYQAKQLHLHWSDLPYKGSEHSLDGEHFAMEMHIVHEKEKG
gi|2554743|  SISGGGLPAPYQAKQLHLHWSDLPYKGSEHSLDGEHFAMEMHIVHEKEKG
gi|2134864|  SISGGGLPAPYQAKQLHLHWSDLPYKGSEHSLDGEHFAMEMHIVHEKEKG
gi|17478944| SISGGGLPAPYQAKQLHLHWSDLPYKGSEHSLDGEHFAMEMHIVHEKEKG 160       170       180       190       200
         ....|....|....|....|....|....|....|....|....|....|
SEC10        TSRNVKEAQDPEDEIAVLAFLVEAGTQVNEGFQPLVEALSNIPKPEMSTT
gi|4502519|  TSRNVKEAQDPEDEIAVLAFLVEAGTQVNEGFQPLVEALSNIPKPEMSTT
gi|409725|   TSRNVKEAQDPEDEIAVLAFLVEAGTQVNEGFQPLVEALSNIPKPEMSTT
gi|2554743|  TSRNVKEAQDPEDEIAVLAFLVEAGTQVNEGFQPLVEALSNIPKPEMSTT
gi|2134864|  TSRNVKEAQDPEDEIAVLAFLVEAGTQVNEGFQPLVEALSNIPKPEMSTT
gi|17478944| TSRNVKEAQDPEDEIAVLAFLVEAGTQVNEGFQPLVEALSNIPKPEMSTT 210       220       230       240       250
         ....|....|....|....|....|....|....|....|....|....|
SEC10        MAESSLLDLLPKEEKLRHYFRYLGSLTTPTCDEKVVWTVF--------RE
gi|4502519|  MAESSLLDLLPKEEKLRHYFRYLGSLTTPTCDEKVVWTVF--------RE
gi|409725|   MAESSLLDLLPKEEKLRHYFRYLGSLTTPTCDEKVVWTVF--------RE
gi|2554743|  MAESSLLDLLPKEEKLRHYFRYLGSLTTPTCDEKVVWTVF--------RE
gi|2134864|  ---SSLLDLLPKEEKLRHYFRYLGSLTTPTCDEKVVWTVF--------RE
gi|17478944| MAESSLLDLLPKEEKLRHYFRYLGSLTTPTCDEKVVXDCVPGAHSASQRT 260       270       280       290       300
         ....|....|....|....|....|....|....|....|....|....|
SEC10        PIQLHREQILAFSQKLYYD------KEQTVSMKDNVR-PLQQLGQRTVIK
gi|4502519|  PIQLHREQILAFSQKLYYD------KEQTVSMKDNVR-PLQQLGQRTVIK
gi|409725|   PIQLHREQILAFSQKLYYD------KEQTVSMKDNVR-PLQQLGQRTVIK
gi|2554743|  PIQLHREQILAFSQKLYYD------KEQTVSMKDNVR-PLQQLGQRTVIK
gi|2134864|  PIQLHREQILAFSQKLYYD------KEQTVSMKDNVR-PLQQLGQRTVIK
gi|17478944| DPGILSEAVLRQGTDSEHEGQCQAPAAAGAAHGDKVRGPGSAAALGPACP 310       320       330
         ....|....|....|....|....|....|....|..
SEC10        SGAEGRPLPWALPA-----LLGPMLACLLAGELR---
gi|4502519|  SGAEGRPLPWALPA-----LLGPMLACLLAGELR---
gi|409725|   SGAEGRPLPWALPA-----LLGPMLACLLAGELR---
gi|2554743|  S------------------------------------
gi|2134864|  -------------------------------------
gi|17478944| AGPECWPACWPASCNDASLLHAPSLLPQLSKEQASGP
```

The presence of identifiable domains in SEC10, as well as all other SECX proteins, was determined by searches using software algorithms such as PROSITE, DOMAIN, Blocks, Pfam, ProDomain, and Prints, and then determining the Interpro number by crossing the domain match (or numbers) using the Interpro website (http:www.ebi.ac.uk/interpro). DOMAIN results for SEC10 as disclosed in Table 10F, were collected from the Conserved Domain Database (CDD) with Reverse Position Specific BLAST analyses. This BLAST analysis software samples domains found in the Smart and Pfam collections. Fully conserved single residues are indicated by the sign (|) and "strong" semi-conserved residues are indicated by the sign (+). The "strong" group of conserved amino acid residues may be any one of the following groups of amino acids: STA, NEQK, NHQK, NDEQ, QHRK, MILV, MILF, HY, FYW.

Table 10F lists the domain description from DOMAIN analysis results against SEC10. This indicates that the SEC10 sequence has properties similar to those of other proteins known to contain this domain.

TABLE 10F

Domain Analysis of SEC10

```
gnl|Pfam|pfam00194, carb_anhydrase, Eukaryotic-type carbonic anhydrase.
CD-Length=255 residues, 100.0% aligned
Score=329 bits (844), Expect=1e-91

SEC10:   23  WCYEVQAESSNYPCLVPVKWGGNCQKDRQSPINIVTTKAKVDKKLGRFFFSGYDKKQTWT  82  (SEQ ID NO: 304)
             W Y V    ++P L P+  G     DRQSPINI T KA+ D L     S Y
```

TABLE 10F-continued

Domain Analysis of SEC10

```
Sbjct:    1 WGYGVHNGPEHWPLLYPIAGG-----DRQSPINIQTKKARYDPSLKPLSVSYYAATAK-E  54

SEC10:   83 VQNNGHSVMMLLEN---KASISGGGLPAPYQAKQLHLHWSDLPYKGSEHSLDGEHFAMEM 139
            + NNGHSV +  ++    K+ +SGG LPAPY+ KQ H HW      GSEH++DG  +  E+
Sbjct:   55 ITNNGHSVQVEFDDSMDKSVLSGGPLPAPYRLKQFHFHWGSSNEHGSEHTVDGVKYPAEL 114

SEC10:  140 HIVHEKEKGTSRNVKEAQDPEDEIAVLAFLVEAGTQVNEGFQPLVEALSNIPKPEMSTTM 199
            H+VH        + KEAQ   D +AVL    V+ G   N G Q LV+AL NI     S T
Sbjct:  115 HLVHWNS-TKYGSYKEAQKKPDGLAVLGVFVKVG-AENPGLQKLVDALQNIKTKGKSATF 172

SEC10:  200 AESSLLDLLPKEEKLRHYFRYLGSLTTPTCDEKVVWTVFREPIQLHREQILAFSQKLYYD 259
                    DLLP     LR Y+ Y GSLTTP C E V W V +EPI +   EQ+  F   L+
Sbjct:  173 TNFDPSDLLP---ALRDYWTYPGSLTTPPCTESVTWIVLKEPITVSSEQLEKFRSLLFSV 229

SEC10:  260 K-EQTVSMKDNVRPLQQLGQRTVIKS 284
            + E+ V M DN RP Q L  R V  S
Sbjct:  230 EGEEEVPMVDNYRPTQPLKGRVVRAS 255
```

Carbonic anhydrases, disclosed as SEC10 herein, are proteins involved in the catalytic hydration of carbon dioxide to carbonic acid. There is increasing evidence that hypoxia-regulated gene expression influences tumor aggressiveness, contributing to the poorer outcome of patients with hypoxic tumors. The role of the transcriptional complex hypoxia-inducible factor-1 as an important mediator of hypoxia-regulated gene expression is one of the best documented pathways. Recently, it has emerged that certain tumor-associated carbonic anhydrases (CAs) can be added to the list of known hypoxia-inducible factor-responsive genes. CA expression in tumors with low vascularization defined a prognosis similar to the one of patients with highly angiogenic tumors. Multivariate analysis revealed that CA expression is a significant prognostic factor independent of angiogenesis. The expression of CA is linked to the expression of a constellation of proteins involved in angiogenesis, apoptosis inhibition, and cell-cell adhesion disruption, which explains the strong association of CA with poor outcome.

The SEC10 disclosed in this invention is expressed in at least the following tissues: apical microvilli of the retinal pigment epithelium, arterial (aortic), basal forebrain, brain, Burkitt lymphoma cell lines, corpus callosum, cardiac (atria and ventricle), caudate nucleus, CNS and peripheral tissue, cerebellum, cerebral cortex, colon, cortical neurogenic cells, endothelial (coronary artery and umbilical vein) cells, palate epithelia, eye, neonatal eye, frontal cortex, fetal hematopoietic cells, heart, hippocampus, hypothalamus, leukocytes, liver, fetal liver, lung, lung lymphoma cell lines, fetal lymphoid tissue, adult lymphoid tissue, those that express MHC I, II, and III, nervous tissues, medulla, subthalamic nucleus, ovary, pancreas, pituitary, placenta, pons, prostate, putamen, serum, skeletal muscle, small intestine, smooth muscle (coronary artery in aortia) spinal cord, spleen, stomach, taste receptor cells of the tongue, testis, thalamus, and thymus tissue. This information was derived by determining the tissue sources of the sequences that were included in the invention including but not limited to Seq-Calling sources, public EST sources, literature sources, and/or RACE sources. Further expression data for SEC10 is provided in Example 2.

The nucleic acids and proteins of SEC10 are useful in potential therapeutic applications implicated in various SEC-related pathological disorders described further herein. The SEC10 nucleic acid encoding the carbonic anhydrase-like protein of the invention, or fragments thereof, may further be useful in diagnostic applications, wherein the presence or amount of the nucleic acid or the protein are to be assessed.

These materials are further useful in the generation of antibodies that bind immunospecifically to the substances of the invention for use in therapeutic or diagnostic methods. These antibodies may be generated according to methods known in the art, using prediction from hydrophobicity charts, as described in the "Anti-SECX Antibodies" section below. The disclosed SEC10 protein has multiple hydrophilic regions, each of which can be used as an immunogen. In one embodiment, for example, a contemplated SEC10 epitope comprises from about amino acids 20 to about 100. In another embodiment, for example, a SEC10 epitope comprises from about amino acids 102 to about 160. In further embodiments, for example, a SEC10 epitope comprises from about 175 to about 290.

SEC11

The disclosed SEC11 (alternatively referred to herein as CG50379-01) includes the 2814 nucleotide sequence (SEQ ID NO:21) shown in Table 11A. A SEC11 ORF begins with a Kozak consensus ATG initiation codon at nucleotides 21–23 and ends with a TAG codon at nucleotides 1764–1766. The SEC11 gene was mapped to human chromosome 12q24.33.

TABLE 11A

SEC11 Nucleotide Sequence

NGNACACGTCCAACGCCAGCATGCAGCGCCCGGGCCCCCGCCTGTGGCTGGTCCTGCAGG (SEQ ID NO:21)

TGATGGGCTCGTGCGCCGCCATCAGCTCCATGGACATGGAGCGCCCGGGCGACGGCAAAT

GCCAGCCCATCGAGATCCCGATGTGCAAGGACATCGGCTACAACATGACTCGTATGCCCA

ACCTGATGGGCCACGAGAACCAGCGCGAGGCAGCCATCCAGTTGCACGAGTTCGCGCCGC

TGGTGGAGTACGGCTGCCACGGCCACCTCCGCTTCTTCCTGTGCTCGCTGTACGCGCCGA

TGTGCACCGAGCAGGTCTCTACCCCCATCCCCGCCTGCCGGGTCATGTGCGAGCAGGCCC

GGCTCAAGTGCTCCCCGATTATGGAGCAGTTCAACTTCAAGTGGCCCGACTCCCTGGACT

GCCGGAAACTCCCCAACAAGAACGACCCCAACTACCTGTGCATGGAGGCGCCCAACAACG

GCTCGGACGAGCCCACCCGGGGCTCGGGCCTGTTCCCGCCGCTGTTCCGGCCGCAGCGGC

CCCACAGCGCGCAGGAGCACCCGCTGAAGGACGGGGGCCCCGGGCGCGGCGGCTGCGACA

ACCCGGGCAAGTTCCACCACGTGGAGAAGAGCGCGTCGTGCGCGCCGCTCTGCACGCCCG

GCGTGGACGTGTACTGGAGCCGCGAGGACAAGCGCTTCGCAGTGGTCTGGCTGGCCATCT

GGGCGGTGCTGTGCTTCTTCTCCAGCGCCTTCACCGTGCTCACCTTCCTCATCGACCCGG

CCCGCTTCCGCTACCCCGAGCGCCCCATCATCTTCCTCTCCATGTGCTACTGCGTCTACT

CCGTGGGCTACCTCATCCGCCTCTTCGCCGGCGCCGAGAGCATCGCCTGCGACCGGGACA

GCGGCCAGCTCTATGTCATCCAGGAGGGACTGGAGAGCACCGGCTGCACGCTGGTCTTCC

TGGTCCTCTACTACTTCGGCATGGCCAGCTCGCTGTGGTGGGTGGTCCTCACGCTCACCT

GGTTCCTGGCCGCCGGCAAGAAGTGGGGCCACGAGGCCATCGAAGCCAACAGCAGCTACT

TCCACCTGGCAGCCTGGGCCATCCCGGCGGTGAAGACCATCCTGATCCTGGTCATGCGCA

GGGTGGCGGGGACGAGCTCACCGGGGTCTGCTACGTGGGCAGCATGGACGTCAACGCGC

TCACCGGCTTCGTGCTCATTCCCCTGGCCTGCTACCTGGTCATCGGCACGTCCTTCATCC

TCTCGGGCTTCGTGGCCCTGTTCCACATCCGGAGGGTGATGAAGACGGGCGGCGAGAACA

CGGACAAGCTGGAGAAGCTCATGGTGCGTATCGGGCTCTTCTCTGTGCTGTACACCGTGC

CGGCCACCTGTGTGATCGCCTGCTACTTTTACGAACGCCTCAACATGGATTACTGGAAGA

TCCTGGCGGCGCAGCACAAGTGCAAAATGAACAACCAGACTAAAACGCTGGACTGCCTGA

TGGCCGCCTCCATCCCCGCCGTGGAGATCTTCATGGTGAAGATCTTTATGCTGCTGGTGG

TGGGGATCACCAGCGGGATGTGGATTTGGACCTCCAAGACTCTGCAGTCCTGGCAGCAGG

TGTGCAGCCGTAGGTTAAAGAAGAAGAGCCGGAGAAAACCGGCCAGCGTGATCACCAGCG

GTGGGATTTACAAAAAAGCCCAGCATCCCCAGAAAACTCACCACCGGAAATATGAGATCC

CTGCCCAGTCGCCCACCTGCGTGTGAACAGGGCTGGAGGGAAGGGCACAGGGGCGCCCGG

AGCTAAGATGTGGTGCTTTTCTTGGTTGTGTTTTTCTTTCTTCTTCTTCTTTTTTTTTTT

TTTATAAAAGCAAAAGAGAAATACATAAAAAAGTGTTTACCCTGAAATTCAGGATGCTGT

GATACACTGAAAGGAAAAATGTACTTAAAGGGTTTTGTTTTGTTTTGGTTTTCCAGCGAA

GGGAAGCTCCTCCAGTGAAGTAGCCTCTTGTGTAACTAATTTGTGGTAAAGTAGTTGATT

CAGCCCTCAGAAGAAAACTTTTGTTTAGAGCCCTCCGTAAATATACATCTGTGTATTTGA

GTTGGCTTTGCTACCCATTTACAAATAAGAGGACAGATAACTGCTTTGCAAATTCAAGAG

CCTCCCCTGGGTTAACAAATGAGCCATCCCCAGGGCCCACCCCCAGGAAGGCCACAGTGC

TGGGCGGCATCCCTGCAGAGGAAAGACAGGACCCGGGGCCCGCCTCACACCCCAGTGGAT

TABLE 11A-continued

SEC11 Nucleotide Sequence

TTGGAGTTGCTTAAAATAGACTCTGGCCTTCACCAATAGTCTCTCTGCAAGACAGAAACC

TCCATCAAACCTCACATTTGTGAACTCAAACGATGTGCAATACATTTTTTTCTCTTTCCT

TGAAAATAAAAAGAGAAACAAGTATTTTGCTATATATAAAGACAACAAAAGAAATCTCCT

AACAAAAGAACTAAGAGGCCCAGCCCTCAGAAACCCTTCAGTGCTACATTTTGTGGCTTT

TTAATGGAAACCAAGCCAATGTTATAGACGTTTGGACTGATTTGTGGAAAGGAGGGGGGA

AGAGGGAGAAGGATCATTCAAAAGTTACCCAAAGGGCTTATTGACTCTTTCTATTGTTAA

ACAAATGATTTCCACAAACAGATCAGGAAGCACTAGGTTGGCAGAGACACTTTGTCTAGT

GTATTCTCTTCACAGTGCCAGGAAAGAGTGGTTTCTGCGTGTGTATATTTGTAATATATG

ATATTTTTCATGCTCCACTATTTTATTAAAAATAAAATATGTTCTTTAAAAAAA

The SEC11 polypeptide (SEQ ID NO:22) encoded by SEQ ID NO:21 is 581 amino acids in length and is presented using the one-letter amino acid code in Table 11B. The Psort profile for SEC11 predicts that this sequence has a signal peptide and is likely to be localized at the plasma membrane with a certainty of 0.6400. In alternative embodiments, a SEC11 polypeptide is located to the Golgi body with a certainty of 0.4600, to the endoplasmic reticulum (membrane) with a certainty of 0.3700, or to the endoplasmic reticulum (lumen) with a certainty of 0.1000. The Signal P predicts a likely cleavage site for a SEC11 peptide is between positions 20 and 21, i.e., at the dash in the sequence CAA-IS.

TABLE 11B

SEC11 protein sequence

MQRPGPRLWLVLQVMGSCAAISSMDMERPGDGKCQPIEIPMCKDIGYNMTRMPNLMGHEN (SEQ ID NO:22)

QREAAIQLHEFAPLVEYGCHGHLRFFLCSLYAPMCTEQVSTPIPACRVMCEQARLKCSPI

MEQFNFKWPDSLDCRKLPNKNDPNYLCMEAPNNGSDEPTRGSGLFPPLFRPQRPHSAQEH

PLKDGGPGRGGCDNPGKFHHVEKSASCAPLCTPGVDVYWSREDKRFAVVWLAIWAVLCFF

SSAFTVLTFLIDPARFRYPERPIIFLSMCYCVYSVGYLIRLFAGAESIACDRDSGQLYVI

QEGLESTGCTLVFLVLYYFGMASSLWWVVLTLTWFLAAGKKWGHEAIEANSSYFHLAAWA

IPAVKTILILVMRRVAGDELTGVCYVGSMDVNALTGFVLIPLACYLVIGTSFILSGFVAL

FHIRRVMKTGGENTDKEKLMVRIGLFSVLYTVPATCVIACYFYERLNMDYWKILAAQHK

CKMNNQTKTLDCLMAASIPAVEIFMVKIFMLLVVGITSGMWIWTSKTLQSWQQVCSRRLK

KKSRRKPASVITSGGIYKKAQHPQKTHHGKYEIPAQSPTCV

TABLE 11C

BLASTX results from PatP database for SEC11

| Sequences producing High-scoring Segment Pairs: | High Score | Smallest Sum Probability P (N) |
| --- | --- | --- |
| patp: AAB73308 Human frizzled family protein 584 | 3151 | 0.0 |
| patp: AAB73307 Mouse frizzled family protein 584 | 2971 | 1.8e−309 |
| patp: AAY90903 Human frizzled-4 protein sequence | 952 | 3.5e−149 |
| patp: AAW31270 Mouse frizzled-4 protein Mfz4 | 949 | 4.5e−149 |
| patp: AAB12117 Hydrophobic domain protein | 1279 | 3.6e−130 |

In a search of public sequence databases, it was found, for example, that the amino acid sequence of the SEC11 protein A BLAST analysis of SEC11 was run against the proprietary PatP GENESEQ Protein Patent database. It was found, for example, that the amino acid sequence of SEC11 had high homology to other proteins as shown in Table 11C.

of the present invention was found to have 581 of 581 amino acid residues (100%) identical to the 581 amino acid NM_007197. SEC11 also has homology to the other proteins shown in the BLASTP data in Table 11D.

TABLE 11D

SEC11 BLASTP results

| Gene Index/Identifier | Protein/Organism | Length (aa) | Identity (%) | Positive (%) | Expect |
|---|---|---|---|---|---|
| gi\|6005762\|ref\|NP_009128.1\| (NM_007197) | frizzled homolog 10 (Drosophila); frizzled (Drosophila) homolog 10 [*Homo sapiens*] | 581 | 581/581 (100) | 581/581 (100) | 0.0 |
| gi\|17433077\|sp\|Q9PWH2\|FZ1C CHICK | Frizzled 10 precursor (Frizzled-10) (Fz-10) (cFz-10) | 585 | 502/564 (89) | 531/564 (94) | 0.0 |
| gi\|17433043\|sp\|Q9DEB5\|FZ0A XENLA | Frizzled 10A precursor (Frizzled-10A) (Fz-10A) (Xfz10A) | 586 | 489/577 (84) | 528/577 (90) | 0.0 |
| gi\|17433096\|sp\|Q9W742\|FZ0B XENLA | Frizzled 10B precursor (Frizzled-10B) (Fz-10B) (Xfz10B) (Frizzled 9) (Xfz9) | 580 | 482/564 (85) | 521/564 (91) | 0.0 |
| gi\|16508271\|emb\|CAD10102.1\| (AL591180) | SC: dZ243A08.3 (frizzled homologue B) [*Daniorerio*] | 580 | 437/566 (77) | 493/566 (86) | 0.0 |

This BLASTP data is displayed graphically in the ClustalW in Table 11E. A multiple sequence alignment is given in Table 11E, with the SEC11 protein being shown on line 1, in a ClustalW analysis comparing the protein of the invention with the related protein sequences, shown in Table 11D.

TABLE 11E

ClustalW Alignment of SEC11

```
1) SEC11          (SEQ ID NO:22)
2) gi|6005762|    (SEQ ID NO:91)
3) gi|17433077|   (SEQ ID NO:92)
4) gi|17433043|   (SEQ ID NO:93)
5) gi|17433096|   (SEQ ID NO:94)
6) gi|16508271|   (SEQ ID NO:95)

10         20         30         40         50
                 ....|....|....|....|....|....|....|....|....|....|
SEC11            MQRPG-----PRLWLVLQVMGS-CAAISSMDMERPGDGKCQPIEIPMCKD
gi|6005762|      MQRPG-----PRLWLVLQVMGS-CAAISSMDMERPGDGKCQPIEIPMCKD
gi|17433077|     MGPAAGN--LVRAVLALCWLAEHCAGISSIDIERPGDGRCQPIEIPMCKD
gi|17433043|     MDVSCVTGLLRGTALLLVLAAALCSAISSINPDRSGDGRCQAIEIPMCKD
gi|17433096|     MEPRVVT------ALLLSLAAALCSGISSINPDRSGEGRCQAIEIPMCKD
gi|16508271|     MFAAG-----VGISLGLLCFAGFCSAISSIDPDRPGEGRCQEIAIPLCKD 60         70         80         90        100
                 ....|....|....|....|....|....|....|....|....|....|
SEC11            IGYNMTRMPNLMGHENQREAAIQLHEFAPLVEYGCHGHLRFFLCSLYAPM
gi|6005762|      IGYNMTRMPNLMGHENQREAAIQLHEFAPLVEYGCHGHLRFFLCSLYAPM
gi|17433077|     IGYNMTRMPNLMGHENQREAAIQLHEFAPLVEYGCHGHLKFFLCSLYAPM
gi|17433043|     IGYNMTRMPNLMGHENQKEAAIQLHEFAPLVEYGCHGHLKFFLCSLYAPM
gi|17433096|     IGYNMTRMPNLMGHENQKEAAIQLHEFAPLVEYGCHGHLKFFLCSLYAPM
gi|16508271|     IGYNETVMPNLMGHEDQNEAAIKLHEFAPLIEEGCHSHLKFFLCSLYAPM 110        120        130        140        150
                 ....|....|....|....|....|....|....|....|....|....|
SEC11            CTEQVSTPIPACRVMCEQARLKCSPIMEQFNFKWPDSLDCRKLPNKNDPN
gi|6005762|      CTEQVSTPIPACRVMCEQARLKCSPIMEQFNFKWPDSLDCRKLPNKNDPN
gi|17433077|     CTEQVSTPIPACRVMCEQARLKCSPIMEQFNFKWPDSLDCSKLPNKNDPN
gi|17433043|     CTEQVSTPIPACRVMCEQARLKCSPIMEQFNFKWPDSLDCSKLPNKNDPN
gi|17433096|     CTEQVSTPIPACRVMCEQARLKCSPIMEQFNFKWPDSLDCSKLPNKNDPN
gi|16508271|     CTEQVSTPIPACRVMCEQARQKCSPIMEQFNFHWPESLDCSRLPNKNDPN 160        170        180        190        200
                 ....|....|....|....|....|....|....|....|....|....|
SEC11            YLCMEAPNNGSDEPTRGSGLFPPLFRPQRPHSAQEHPLKDGGPGRGGCEN
gi|6005762|      YLCMEAPNNGSDEPTRGSGLFPPLFRPQRPHSAQEHPLKDGGPGRGGCEN
gi|17433077|     YLCMEAPNNGSDEPPRGSSMLPPMFRPQRPSTGHDLQQHKDSLSRTECEN
gi|17433043|     YLCMEAPNNGTDETPRGSSMLPPIFRPQRPSSGHETYPKD-PTSRSSCEN
gi|17433096|     YLCMEAPNNGTDEAPRSSSILPPIFRPQRPNSGHEMYPKD-PKGRSSCEN
gi|16508271|     YLCMEAPNNGTDEPPKGSHTQSPDSRPPRPGNSQELPIKE-RVGKTICSN
```

TABLE 11E-continued

ClustalW Alignment of SEC11

```
                  210       220       230       240       250
             ....|....|....|....|....|....|....|....|....|....|
SEC11        PGKFHHVEKSASCAPLCTPGVDVYWSREDKRFAVVWLAIWAVLCFFSSAF
gi|6005762|  PGKFHHVEKSASCAPLCTPGVDVYWSREDKRFAVVWLAIWAVLCFFSSAF
gi|17433077| PGKFHHVEKSASCAPLCTPGVDVYWSKDDKQFAVIWIAIWSILCFFSSAF
gi|17433043| SGKFHHVEKSASCAPLCSSSVDVYWSKDDKKFAFIWIAIWSILCFFSSAF
gi|17433096| SGKFHHVEKSASCAPLCSSSVDVYWSKNDKKFAFIWIAIWSLLCFFSSAF
gi|16508271| PGKFHYVQKSESCAPKCYSNVDVYWSQGDKRFSMVWIAIWSILCFISSAF 260       270       280       290       300
             ....|....|....|....|....|....|....|....|....|....|
SEC11        TVLTFLIDPARFRYPERPIIFLSMCYCVYSVGYEIRLFAGAESIACDRDS
gi|6005762|  TVLTFLIDPARFRYPERPIIFLSMCYCVYSVGYEIRLFAGAESIACDRDS
gi|17433077| TVLTFLIDPQRFKYPERPIIFLSMCYCVYSVGYIIRLFSGAESIACDRDS
gi|17433043| TVLTFLVDPLRFKYPERPIIFLSMCYCVYSVGYIIRLFAGADSIACDRDS
gi|17433096| TVLTFLVDPLRFKYPERPIIFLSMCYCVYSVGYIIRLFAGADSIACDRDS
gi|16508271| TVLTFLIDPQRFKYPERPIIFLSMSYCVYSVGFLVRLFVGVENVACDRDT 310       320       330       340       350
             ....|....|....|....|....|....|....|....|....|....|
SEC11        GQLYVIQEGLESTGCTLVFLVLYYFGMASSLWWVVLTLTWFLAAGKKWGH
gi|6005762|  GQLYVIQEGLESTGCTLVFLVLYYFGMASSLWWVVLTLTWFLAAGKKWGH
gi|17433077| GQLYVIQEGLESTGCTIVFLVLYYFGMASSLWWVILTLTWFLAAGKKWGH
gi|17433043| GQLYVIQEGLESTGCTIVFLILYYFGMASSLWWVILTLTWFLAAGKKWGH
gi|17433096| GQLYVIQEGLESTGCTIVFLILYYFGMASSLWWVILTLTWFLAAGKKWGH
gi|16508271| GVQYRIQEGLESTGCTIVFLILYYFGMASSLWWVILTLTWFLAAGKKWGH 360       370       380       390       400
             ....|....|....|....|....|....|....|....|....|....|
SEC11        EAIEANSSYFHLAAWAIPAVKTILILVMRRVAGDELTGVCYVGSMDVNAL
gi|6005762|  EAIEANSSYFHLAAWAIPAVKTILILVMRRVAGDELTGVCYVGSMDVNAL
gi|17433077| EAIEANSSYFHLAAWAIPAVKTIMILVMRRVAGDELTGLCYVGSMDVNAL
gi|17433043| EAIEANSSYFHLAAWAIPAVKTIMILVMRRVAGDELTGVCYVGSMDVNAL
gi|17433096| EAIEANSSYFHLAAWAIPAVKTIMILVMRRVAGDELTGVCYVGSMDVNAL
gi|16508271| EAIEANSSYFHLAAWAIPAEKTIMILVMRKVAGDELTGVCYVGSMDVKAL 410       420       430       440       450
             ....|....|....|....|....|....|....|....|....|....|
SEC11        TGFVLIPLACYLVIGTSFILSGFVALFHIRRVMKTGGENTDKLEKLMVRI
gi|6005762|  TGFVLIPLACYLVIGTSFILSGFVALFHIRRVMKTGGENTDKLEKLMVRI
gi|17433077| TGFVLIPLACYLIIGTSFILSGFVALFHIRRVMKTGGENTDKLEKLMVRI
gi|17433043| TGFVLIPLACYLIIGTSFILSGFVALFHIRRVMKTGGENTDKLEKLMVRI
gi|17433096| TGFVLIPLACYLIIGTSFILSGFVALFHIRRVMKTGGENTDKLEKLMVRI
gi|16508271| TGFVLIPLSCYLIIGTSFILSGFVALFHIRKVMKTEGENTDKLEKLMVRI 460       470       480       490       500
             ....|....|....|....|....|....|....|....|....|....|
SEC11        GLFSVLYTVPATCVIACYFYERLNMDYWKILAAQHKCKMNNQTKTLDCIM
gi|6005762|  GLFSVLYTVPATCVIACYFYERLNMDYWKILAAQHKCKMNNQTKTLDCIM
gi|17433077| GVFSVLYTVPATCVIACYFYERLNMDYWKIVASQQKCKMNKQTNTLDCMM
gi|17433043| GVFSVLYTVPATCVIACYFYERLNMDFWKILATQDKCKMDSQTKTLDCTM
gi|17433096| GVFSVLYTVPATCVIACYFYERLNMDFWKILATQDKCKMDSQTKTLDCIM
gi|16508271| GVFSVLYTVPATCVIACYFYERLNMDYWKILAGEQKCADDGKSG-EECVM 510       520       530       540       550
             ....|....|....|....|....|....|....|....|....|....|
SEC11        AASIPAVEIFMVKIFMLLVVGITSGMWIWTDKTLQSWQQVCSRRLKKKSR
gi|6005762|  AASIPAVEIFMVKIFMLLVVGITSGMWIWTDKTLQSWQQVCSRRLKKKSR
gi|17433077| NNSIPAVEIFMVKIFMLLVVGITSGMWIWTDKTLQSWQNVCSRRLKKRSR
gi|17433043| TSSIPAVEIFMVKIFMLLVVGITSGMWIWTDKTVQSWQNVFSKRLKKRNR
gi|17433096| TSSIPAVEIFMVKIFMLLVVGITSGMWIWTDKTVQSWQNVFSKSLKKRNR
gi|16508271| KSSIPAVEIFMVKIFMLLVVGITSGMWIWTDKTLQSWQNVFSRSLKKKTR 560       570       580
             ....|....|....|....|....|....|..
SEC11        RKPASVITSGGIYKKAQHPQKTHHGKYEIPAQSPTCV
gi|6005762|  RKPASVITSGGIYKKAQHPQKTHHGKYEIPAQSPTCV
gi|17433077| RKPASVITSSGIYKKPQHPQKTHLAKYESTLQPPTCV
gi|17433043| SKPASVITSAGIYKKPQHPPKTHHGKYESALQSPTCV
gi|17433096| NKPASVITSAGIYKKPQQPPKIHHGKYESALRSPTCV
gi|16508271| RKAACVFTGSCPYLKPHPALKGHKTKYEPAGPPATCV
```

The presence of identifiable domains in SEC11, as well as all other SECX proteins, was determined by searches using software algorithms such as PROSITE, DOMAIN, Blocks, Pfam, ProDomain, and Prints, and then determining the Interpro number by crossing the domain match (or numbers) using the Interpro website (http:www.ebi.ac.uk/interpro). DOMAIN results for SEC11 as disclosed in Table 11F, were collected from the Conserved Domain Database (CDD) with Reverse Position Specific BLAST analyses. This BLAST analysis software samples domains found in the Smart and Pfam collections. Fully conserved single residues are indicated by the sign (|) and "strong" semi-conserved residues are indicated by the sign (+). The "strong" group of conserved amino acid residues may be any one of the following groups of amino acids: STA, NEQK, NHQK, NDEQ, QHRK, MILV, MILF, HY, FYW.

Table 11F lists the domain description from DOMAIN analysis results against SEC11. This indicates that the SEC11 sequence has properties similar to those of other proteins known to contain this domain.

sFRP genes play quite distinct roles in the morphogenesis of several organ systems.

The SEC11 disclosed in this invention is expressed in at least the following tissues: apical microvilli of the retinal pigment epithelium, arterial (aortic), basal forebrain, brain, Burkitt lymphoma cell lines, corpus callosum, cardiac (atria and ventricle), caudate nucleus, CNS and peripheral tissue, cerebellum, cerebral cortex, colon, cortical neurogenic cells, endothelial (coronary artery and umbilical vein) cells, palate

TABLE 11F

Domain Analysis of SEC11

```
gnl|Pfam|pfam01534, Frizzled, Frizzled/Smoothened family membrane region. This
family contains the membrane spanning region of frizzled and smoothened
receptors. This membrane region is predicted to contain seven transmembrane
alpha helices. Proteins related to drosophila frizzled are receptors for the
Wnt signaling molecules. The smoothened receptor mediates hedgehog signaling.
CD-Length=328 residues, 98.2% aligned
Score=418 bits (1075), Expect=4e-118

SEC11:  217 VYWSREDKRFAVVWLAIWAVLCFFSSAFTVLTFLIDPARFRYPERPIIFLSMCYCVYSVG 276 (SEQ ID NO: 305)
            +SR++ RFA  W+A W+ LCF S+ FTVLTFLID  RFRYPERPI +LS CY + SVG
Sbjct:    1 PLFSRDEHRFARSWIAWWSALCFVSTLFTVLTFLIDWKRFRYPERPIFYLSACYLIVSVG  60

SEC11:  277 YLIRLFAGAESIACDR-DSGQLYVIQEGLESTGCTLVFLVLYYFGMASSLWWVVLTLTWF 335
            YLIR F G E IAC + D G   V Q   E+  CT++FL++Y+FGMASS+WWV+LTLTWF
Sbjct:   61 YLIRFFLGREEIACRKADGGMRTVTQCSTENLSCTVLFLLVYFFGMASSVWWVILTLWF  120

SEC11:  336 LAAGKKWGHEAIEANSSYFHLAAWAIPAVKTILILVMRRVAGDELTGVCYVGSMDVNALT 395
            LAAG KWGHEAIEA SSYFHL AW +PAV TI +L + +V GD +TC+C+VG+++++AL
Sbjct:  121 LAAGLKWGHEAIEAKSSYFHLVAWGLPAVLTITVLALNKVDCDPITGICFVGNLNLDALR 180

SEC11:  396 GFVLIPLACYLVIGTSFILSGFVALFHIRRVMKTGGENTDKLEKLMVRIGLFSVLYTVPA 455
            GFVL PL  YLVIGT F+L+CFV+LF IR V+KT G NT KLEKLMVRIG+FS+LYTVPA
Sbjct:  181 GFVLAPLCVYLVIGTLFLLACFVSLFRIRSVIKTQGTNTSKLEKLMVRIGVFSLLYTVPA 240

SEC11:  456 TCVIACYFYERLNMDYWKILAAQHKCK-----MNNQTKTLDCLMAASIPAVEIFMVKIFM 510
               VIACYFYE+ N D W+      C        + K+ D       P + +FM+
               K FM
Sbjct:  241 LIVIACYFYEQANRDEWERSWLDCICCQYQIPCPYKDKSSDPEAR---PPLAVFMLKYFM 297

SEC11:  511 LLVVGITSGMWIWTSKTLQSWQQVC 535
            LVVCITSG+W+W+ KTL+SW++
Sbjct:  298 SLVVGITSGVWVWSKKTLESWRRFF 322
```

Frizzled (FZD) genes, disclosed herein as SEC11, encode receptors for WNTs, which play key roles in carcinogenesis and embryogenesis. Homologues of the N-terminal region of frizzled exist either as transmembrane or secreted molecules. The secreted frizzled related protein 2 (sFRP2) is upregulated within 2 days of in vitro development. In vivo sFRP2 expression was likewise found in mesenchymal condensates and subsequent epithelial structures. Detailed in situ hybridization analysis revealed sFRP2 expression during development of the eye, brain, neural tube, craniofacial mesenchyme, joints, testis, pancreas and below the epithelia of oesophagus, aorta and ureter where smooth muscles develop. In a comparative analysis, transcripts of the related sFRP1 and sFRP4 genes were frequently found in the same tissues as sFRP2 with their expression domains overlapping in some instances, but mutually exclusive in others. While sFRP1 is specifically expressed in the embryonic metanephros, eye, brain, teeth, salivary gland and small intestine, there is only weak expression of sFRP4 except for the developing teeth, eye and salivary gland. Nevertheless, epithelia, eye, neonatal eye, frontal cortex, fetal hematopoietic cells, heart, hippocampus, hypothalamus, leukocytes, liver, fetal liver, lung, lung lymphoma cell lines, fetal lymphoid tissue, adult lymphoid tissue, those that express MHC I, II, and III, nervous tissues, medulla, subthalamic nucleus, ovary, pancreas, pituitary, placenta, pons, prostate, putamen, serum, skeletal muscle, small intestine, smooth muscle (coronary artery in aortia) spinal cord, spleen, stomach, taste receptor cells of the tongue, testis, thalamus, and thymus tissue. This information was derived by determining the tissue sources of the sequences that were included in the invention including but not limited to Seq-Calling sources, public EST sources, literature sources, and/or RACE sources. Further expression data for SEC11 is provided in Example 2.

The nucleic acids and proteins of SEC11 are useful in potential therapeutic applications implicated in various SEC-related pathological disorders described further herein. The SEC11 nucleic acid encoding the FZD10-like protein of the invention, or fragments thereof, may further be useful in diagnostic applications, wherein the presence or amount of the nucleic acid or the protein are to be assessed.

These materials are further useful in the generation of antibodies that bind immunospecifically to the substances of the invention for use in therapeutic or diagnostic methods. These antibodies may be generated according to methods known in the art, using prediction from hydrophobicity charts, as described in the "Anti-SECX Antibodies" section below. The disclosed SEC11 protein has multiple hydrophilic regions, each of which can be used as an immunogen. In one embodiment, for example, a contemplated SEC11 epitope comprises from about amino acids 20 to about 85. In another embodiment, for example, a SEC11 epitope comprises from about amino acids 110 to about 200. In further embodiments, for example, a SEC11 epitope comprises from about 240 to about 260, from about 261 to about 290, from about 330 to 350, from about 420 to 430, from about 460 to 490, and about 520 to 581.

SEC12

The disclosed SEC12 (alternatively referred to herein as CG56035-01) includes the 2840 nucleotide sequence (SEQ ID NO:23) shown in Table 12A. A SEC12 ORF begins with a Kozak consensus ATG initiation codon at nucleotides 258–260 and ends with a TGA codon at nucleotides 1296–1298.

TABLE 12A

SEC12 Nucleotide Sequence

CAGCGGCCGCTGAATTCTAGGGCGGGTTCGCGCCCCGAAGGCTGAGAGCTGGCGCTGCTC (SEQ ID NO:23)

GTGCCCTGTGTGCCAGACGGCGGAGCTCCGCGGCCGGACCCCGCGGCCCCGCTTTGCTGC

CGACTGGAGTTTGGGGGAAGAAACTCTCCTGCGCCCCAGAAGATTTCTTCCTCGGCGAAG

GGACAGCGAAAGATGAGGGTGGCAGGAAGAGAACGCGCTTTCTGTCTGCCGGGGTCGCAG

CGCGAGAGGGCAGTGCCATGTTCCTCTCCATCCTAGTGGCGCTGTGCCTGTGGCTGCACC

TGGCGCTGGGCGTGCGCGGCGCGCCCTGCGAGGCGGTGCGCATCCCTATGTGCCGGCACA

TGCCCTGGAACATCACGCGGATGCCCAACCACCTGCACCACAGCACGCACGAGAACGCCA

TCCTGGCCATCGAGCAGTACGAGGAGCTGGTGGACGTGAACTGCAGCGCCGTGCTGCGCT

TCTTCTTCTGTGCCATGTACGCGCCCATTTGCACCCTGGAGTTCCTGCACGACCCTATCA

AGCCGTGCAAGTCGGTGTGCCAACGCGCGCGCGACGACTGCGAGCCCCTCATGAAGATGT

ACAACCACAGCTGGCCCGAAAGCCTGGCCTGCGACGAGCTGCCTGTCTATGACCGTGGCG

TGTGCATTTCGCCTGAAGCCATCGTCACGGACCTCCCGGAGGATGTTAAGTGGATAGACA

TCACACCAGACATGATGGTACAGGAAAGGCCTCTTGATGTTGACTGTAAACGCCTAAGCC

CCGATCGGTGCAAGTGTAAAAAGGTGAAGCCAACTTTGGCAACGTATCTCAGCAAAAACT

ACAGCTATGTTATTCATGCCAAAATAAAAGCTGTGCAGAGGAGTGGCTGCAATGAGGTCA

CAACGGTGGTGGATGTAAAAGAGATCTTCAAGTCCTCATCACCCATCCCTCGAACTCAAG

TCCCGCTCATTACAAATTCTTCTTGCCAGTGTCCACACATCCTGCCCCATCAAGATGTTC

TCATCATGTGTTACGAGTGGCGTTCAAGGATGATGCTTCTTGAAAATTGCTTAGTTGAAA

AATGGAGAGATCAGCTTAGTAAAAGATCCATACAGTGGGAAGAGAGGCTGCAGGAACAGC

GGAGAACAGTTCAGGACAAGAAGAAAACAGCCGGGCGCACCAGTCGTAGTAATCCCCCCA

AACCAAAGGGAAAGCCTCCTGCTCCCAAACCAGCCAGTCCCAAGAAGAACATTAAAACTA

GGAGTGCCCAGAAGAGAACAAACCCGAAAAGAGTGTGAGCTAACTAGTTTCCAAAGCGGA

GACTTCCGACTTCCTTACAGGATGAGGCTGGGCATTGCCTGGGACAGCCTATGTAAGGCC

ATGTGCCCCTTGCCCTAACAACTCACTGCAGTGCTCTTCATAGACACATCTTGCAGCATT

TTTCTTAAGGCTATGCTTCAGTTTTTCTTTGTAAGCCATCACAAGCCATAGTGGTAGGTT

TGCCCTTTGGTACAGAAGGTGAGTTAAAGCTGGTGGAAAAGGCTTATTCCATTGCATTCA

GAGTAACCTGTGTGCATACTCTAGAAGAGTAGGGAAAATAATGCTTGTTACAATTCGACC

TAATATGTGCATTGTAAAATAAATGCCATATTTCAAACAAAACACGTAATTTTTTTACAG

TABLE 12A-continued

SEC12 Nucleotide Sequence

```
TATGTTTTATTACCTTTTGATATCTGTTGTTGCAATGTTAGTGATGTTTTAAAATGTGAT

GAAAATATAATGTTTTTAAGAAGGAACAGTAGTGGAATGAATGTTAAAAGATCTTTATGT

GTTTATGGTCTGCAGAAGGATTTTTGTGATGAAAGGGGATTTTTTGAAAAATTAGAGAAG

TAGCATATGGAAAATTATAATGTGTTTTTTTACCAATGACTTCAGTTTCTGTTTTTAGCT

AGAAACTTAAAAACAAAAATAATAATAAAGAAAAATAAATAAAAAGGAGAGGCAGACAAT

GTCTGGATTCCTGTTTTTGGTTACCTGATTTCCATGATCATGATGCTTCTTGTCAACAC

CCTCTTAAGCAGCACCAGAAACAGTGAGTTTGTCTGTACCATTAGGAGTTAGGTACTAAT

TAGTTGGCTAATGCTCAAGTATTTTATACCCACAAGAGAGGTATGTCACTCATCTTACTT

CCCAGGACATCCACCCTGAGAATAATTTGACAAGCTTAAAAATGGCCTTCATGTGAGTGC

CAAATTTTGTTTTTCTTCATTTAAATATTTTCTTTGCCTAAATACATGTGAGAGGAGTTA

AATATAAATGTACAGAGAGGAAAGTTGAGTTCCACCTCTGAAATGAGAATTACTTGACAG

TTGGGATACTTTAATCAGAAAAAAAGAACTTATTTGCAGCATTTTATCAACAAATTTCAT

AATTGTGGACAATTGGAGGCATTTATTTTAAAAAACAATTTTATTGGCCTTTTGCTAACA

CAGTAAGCATGTATTTTATAAGGCATTCAATAAATGCACAACGCCCAAAGGAAATAAAAT

CCTATCTAATCCTACTCTCCACTACACACAGGTAATCACTATTAGTATTTTGGCATATTA

TTCTCCAGGTGTTTGCTTATGCACTTATAAAATGATTTGAACAAATAAAACTAGGAACCT

GTATACATGTGTTTCATAACCTGCCTCCTTTGCTTGGCCCTTTATTGAGATAAGTTTTCC

TGTCAAGAAAGCAGAAACCATCTCATTTCTAACAGCTGTGTTATATTCCATAGTATGCAT

TACTCAACAAACTGTTGTGCTATTGGATACTTAGGTGGTTTCTTCACTGACAATACTGAA

TAAACATCTCACCGGAATTC
```

The SEC12 polypeptide (SEQ ID NO:24) encoded by SEQ ID NO:23 is 346 amino acids in length and is presented using the one-letter amino acid code in Table 12B. The Psort profile for SEC12 predicts that this sequence has a signal peptide and is likely to be secreted from the cell with a certainty of 0.8200. In alternative embodiments, a SEC12 polypeptide is located to lysosomes with a certainty of 0.1900, or to the endoplasmic reticulum (membrane) with a certainty of 0.1000. The Signal P predicts a likely cleavage site for a SEC12 peptide is between positions 21 and 22, i.e., at the dash in the sequence VRG-AP.

TABLE 12B

SEC12 protein sequence

MFLSILVALCLWLHLALGVRGAPCEAVRIPMCRHMPWNITRMPNHLHHSTQENAILAIEQ   (SEQ ID NO:24)

YEELVDVNCSAVLRFFFCAMYAPICTLEFLHDPTKPCKSVCQRARDDCEPLMKMYNHSWP

ESLACDELPVYDRGVCISPEAIVTDLPEDVKWIDITPDMMVQERPLDVDCKRLSPDRCKC

KKVKPTLATYLSKNYSYVIHAKIKAVQRSGCNEVTTVVDVKEIFKSSSPIPRTQVPLITN

SSCQCPHILPHQDVLIMCYEWRSRMMLLENCLVEKWRDQLSKRSIQWEERLQEQRRTVQD

KKKTAGRTSRSNPPKPKGKPPAPKPASPKKNIKTRSAQKRTNPKRV

A BLAST analysis of SEC12 was run against the proprietary PatP GENESEQ Protein Patent database. It was found, for example, that the amino acid sequence of SEC12 had high homology to other proteins as shown in Table 12C.

TABLE 12C

BLASTX results from PatP database for SEC12

| Sequences producing High-scoring Segment Pairs: | High Score | Smallest Sum Probability P (N) |
|---|---|---|
| patp: AAB00193 Breast cancer protein BCX2 - *Homo sapiens* | 1879 | 9.5e–194 |
| patp: AAB76853 Human lung tumour protein related protein | 1879 | 9.5e–194 |

TABLE 12C-continued

BLASTX results from PatP database for SEC12

| Sequences producing High-scoring Segment Pairs: | High Score | Smallest Sum Probability P (N) |
|---|---|---|
| patp: AAW73508 Human ATG-1639 protein | 1870 | 8.6e–193 |
| patp: AAY03232 Full length sequence of the human frezzled | 1865 | 2.9e–192 |
| patp: AAB48183 Human FRAZZLED polypeptide | 1865 | 2.9e–192 |

In a search of public sequence databases, it was found, for example, that the amino acid sequence of the SEC12 protein of the present invention was found to have 346 of 346 amino acid residues (100%) identical to the 346 amino acid NM_003014. SEC12 also has homology to the other proteins shown in the BLASTP data in Table 12D.

TABLE 12D

SEC12 BLASTP results

| Gene Index/ Identifier | Protein/Organism | Length (aa) | Identity (%) | Positive (%) | Expect |
|---|---|---|---|---|---|
| gi\|4506895\|ref\| NP_003005.1\| (NM_003014) | secreted frizzled-related protein 4; secreted frizzled-related protein 4 [*Homo sapiens*] | 346 | 346/346 (100) | 346/346 (100) | e–179 |
| gi\|14749431\|ref\| XP_004706.3\| (XM_004706) | secreted frizzled-related protein 4; secreted frizzled-related protein 4 [*Homo sapiens*] | 346 | 345/346 (99) | 345/346 (99) | e–178 |
| gi\|7672423\|gb \|AAF66480.1\| AF140346_1 (AF140346) | frizzled related protein [*Rattus norvegicus*] | 348 | 319/345 (92) | 327/345 (94) | e–173 |
| gi\|16758312\|ref\| NP_445996.1\| (NM_053544) | frizzled related protein 4 [*Rattus norvegicus*] | 348 | 318/345 (92) | 327/345 (94) | e–171 |
| gi\|7710094\|ref\|NP_057896.1\| (NM_016687) | frizzled related protein sequence 4 [*Rattus norvegicus*] | 351 | 322/348 (92) | 331/348 (94) | e–168 |

This BLASTP data is displayed graphically in the ClustalW in Table 12E. A multiple sequence alignment is given in Table 12E, with the SEC12 protein being shown on line 1, in a ClustalW analysis comparing the protein of the invention with the related protein sequences shown in Table 12D.

TABLE 12E

ClustalW

```
1) SEC12         (SEQ ID NO:24)
2) gi|4506895|   (SEQ ID NO:96)
3) gi|14749431|  (SEQ ID NO:97)
4) gi|7672423|   (SEQ ID NO:98)
5) gi|16758312|  (SEQ ID NO:99)
6) gi|7710094|   (SEQ ID NO:100)

10        20        30        40        50
                 ....|....|....|....|....|....|....|....|....|....|
SEC12            MFLSILVALCLWLHLALGVRGAPCEAVRIPMCRHMPWNITRMPNHLHHST
gi|4506895|      MFLSILVALCLWLHLALGVRGAPCEAVRIPMCRHMPWNITRMPNHLHHST
gi|14749431|     MFLSILVALCLWLHLALGVRGAPCEAVRIPMCRHMPWNITRMPNHLHHST
gi|7672423|      MLLSILVALCLWLRLALGVRGAPCEAVRIPMCRHMPWNITRMPNHLHHST
gi|16758312|     MLLSILVALCLCVRLALGVRGAPCEAVRIPMCRHMPWNITRMPNHLHHST
gi|7710094|      MLRSILVALCLWLRLALGVRGAPCEAVRIPMCRHMPWNITRMPNHLHHST
```

TABLE 12E-continued

```
                                        ClustalW
                  60         70         80         90        100
              ....|....|....|....|....|....|....|....|....|....|
SEC12         QENAILAIEQYEELVDVNCSAVLRFFFCAMYAPICTLEFLHDPIKPCKSV
gi|4506895|   QENAILAIEQYEELVDVNCSAVLRFFFCAMYAPICTLEFLHDPIKPCKSV
gi|14749431|  QENAILAIEQYEELVDVNCSAVLRFFLCAMYAPICTLEFLHDPIKPCKSV
gi|7672423|   QENAILAIEQYEELVDVNCSSVLSFFLCAMYAPICTLEFLHDPIKPCKSV
gi|16758312|  QENAILAIEQYEELVDVNCSSVLRFFLCAMYAPICTLEFLHDPIKPCKSV
gi|7710094|   QENAILAIEQYEELVDVNCSSVLRFFLCAMYAPICTLEFLHDPIKPCKSV 110        120        130        140        150
              ....|....|....|....|....|....|....|....|....|....|
SEC12         CQRADDCEPLMKMYNHSWPESLACDELPVYDRGVCISPEAIVTDLPEDV
gi|4506895|   CQRADDCEPLMKMYNHSWPESLACDELPVYDRGVCISPEAIVTDLPEDV
gi|14749431|  CQRADDCEPLMKMYNHSWPESLACDELPVYDRGVCISPEAIVTDLPEDV
gi|7672423|   CQRADDCEPLMKMYNHSWPESLACDELPVYDRGVCISPEAIVTDLPEDV
gi|16758312|  CQRADDCEPLMKMYNHSWPESLACDELPVYDRGVCISPEAIVTDLPEDV
gi|7710094|   CQRADDCEPLMKMYNHSWPESLACDELPVYDRGVCISPEAIVTDLPEDV 160        170        180        190        200
              ....|....|....|....|....|....|....|....|....|....|
SEC12         KWIDITPDMMVQERPLDVDCKRLSPDRCKCKKVKPTLATYLSKNYSYVIH
gi|4506895|   KWIDITPDMMVQERPLDVDCKRLSPDRCKCKKVKPTLATYLSKNYSYVIH
gi|14749431|  KWIDITPDMMVQERPLDVDCKRLSPDRCKCKKVKPTLATYLSKNYSYVIH
gi|7672423|   KWIDITPDMMVQERSFDADCKHLSPDRCKCKKVKPTLATYLSKNYSYVIH
gi|16758312|  KWIDITPDMMVQERSFDADCKHLSPDRCKCKKVKPTLATYLSKNYSYVIH
gi|7710094|   KWIDITPDMMVQERSFDADCKRLSPDRCKCKKVKPTLATYLSKNYSYVIH 210        220        230        240        250
              ....|....|....|....|....|....|....|....|....|....|
SEC12         AKIKAVQRSGCNEVTTVVDVKEIFKSSSPIPRTQVPLITNSSCQCPHILP
gi|4506895|   AKIKAVQRSGCNEVTTVVDVKEIFKSSSPIPRTQVPLITNSSCQCPHILP
gi|14749431|  AKIKAVQRSGCNEVTTVVDVKEIFKSSSPIPRTQVPLITNSSCQCPHILP
gi|7672423|   AKIKAVQRSGCNEVTTVVDVKEIFKSSSPIPRTQVPLITNSSCQCPHILP
gi|16758312|  AKIKAVQRSGCNEVTTVVDVKEIFKSSSPIPRTQVPLITNSSCQCPHILP
gi|7710094|   AKIKAVQRSGCNEVTTVVDVKEIFKSLSPIPRTQVPLITNSSCQCPHILP 260        270        280        290        300
              ....|....|....|....|....|....|....|....|....|....|
SEC12         HQDVLIMCYEWRSRMMLLENCLVEKWRDQLSKRSIQWEERLQEQRRTVQD
gi|4506895|   HQDVLIMCYEWRSRMMLLENCLVEKWRDQLSKRSIQWEERLQEQRRTVQD
gi|14749431|  HQDVLIMCYEWRSRMMLLENCLVEKWRDQLSKRSIQWEERLQEQRRTVQD
gi|7672423|   HQDVLIMCYEFRSRMMLLENCLVEKWRDQLSKRSTQWEERLQEQQRTTQD
gi|16758312|  XQDVLIMCYERRSRMMLLENCLVEKWRDQLSRRSTQWEERLQEQQRTTQD
gi|7710094|   HQDVLIMCYEWRSRMMLLENCLVEKWRDQLSRRSIQWEERLQEQQRTTQD 310        320        330        340        350
              ....|....|....|....|....|....|....|....|....|....|
SEC12         KKKTAGRTS---RSNPPKPKGKPPAPKPASPKKNIKTRSAQKRTNPKRV-
gi|4506895|   KKKTAGRTS---RSNPPKPKGKPPAPKPASPKKNIKTRSAQKRTNPKRV-
gi|14749431|  KKKTAGRTS---RSNPPKPKGKPPAPKPASPKKNIKTRSAQKRTNPKRV-
gi|7672423|   KKQIASRTS---RSNPPKPKGSPASKPASPKKNIKARSAPKKSNPKKST
gi|16758312|  KKQIASRTS---RSNPPKPKGSPASKPASPKKNIKARSAPKKSNPKKST
gi|7710094|   KKQIASRTSRTSRSNPPKSKGRPPAPKPASPKKNIKARSAPKKSNLKKSA SEC12         .
gi|4506895|   -
gi|14749431|  -
gi|7672423|   S
gi|16758312|  S
gi|7710094|   S
```

The presence of identifiable domains in SEC12, as well as all other SECX proteins, was determined by searches using software algorithms such as PROSITE, DOMAIN, Blocks, Pfam, ProDomain, and Prints, and then determining the Interpro number by crossing the domain match (or numbers) using the Interpro website (http:www.ebi.ac.uk/interpro). DOMAIN results for SEC12 as disclosed in Table 12F, were collected from the Conserved Domain Database (CDD) with Reverse Position Specific BLAST analyses. This BLAST analysis software samples domains found in the Smalt and Pfam collections. Fully conserved single residues are indicated by the sign (|) and "strong" semi-conserved residues are indicated by the sign (+). The "strong" group of conserved amino acid residues may be any one of the following groups of amino acids: STA, NEQK, NHQK, NDEQ, QHRK, MILV, MILF, HY, FYW.

Table 12F lists the domain description from DOMAIN analysis results against SEC12. This indicates that the SEC12 sequence has properties similar to those of other proteins known to contain this domain.

TABLE 12F

Domain Analysis of SEC12

```
gnl|Smart|smart00063, FRI, Frizzled; Drosophila melanogaster frizzled mediates
signalling that polarises a precursor cell along the anteroposterior axis.
Homologues of the N-terminal region of frizzled exist either as transmembrane or
secreted molecules. Frizzled homologues are reported to be receptors for the
Wnt growth factors.
CD-Length = 117 residues, 98.3% aligned
Score = 139 bits (350), Expect = 3e-34

SEC12:    23 PCEVARIPMCRHMPWNITRMPNHLHHSTQENAILAIEQYEELVDVNCSAVLRFFFCAMYA     82
              CE + +P+C+ + +N+T MPN L H+TQE A L + Q+   L++V CS   LRFF C++YA
Sbjct:     1 RCEPITLPLCKDLGYNLTSMPNLLGHTTQEEAGLELSQFYPLLNVQCSPDLRFFLCSVYA     60  (SEQ ID NO:306)

SEC12:    83    PICTLEFLHDPIKPCKSVCQRARDDCEPLMKMYNHSWPESLACDELPVYDRGVCISP 139
                P+CT E L +PI PC+S+C+ AR+ CEPLM+ +   WPE L CD  PV +  +C+ P
Sbjct:    61    PVCTEDLPEPILPCRSLCEAAREGCEPLMEKFGFGWPEFLRCDRFPVQNELCMDPVP 120
```

Frizzled (FZD) genes, disclosed herein as SEC11, encode receptors for WNTs, which play key roles in carcinogenesis and embryogenesis. Homologues of the N-terminal region of frizzled exist either as transmembrane or secreted molecules. The secreted frizzled related protein 2 (sFRP2) is upregulated within 2 days of in vitro development. In vivo sFRP2 expression was likewise found in mesenchymal condensates and subsequent epithelial structures. Detailed in situ hybridization analysis revealed sFRP2 expression during development of the eye, brain, neural tube, craniofacial mesenchyme, joints, testis, pancreas and below the epithelia of oesophagus, aorta and ureter where smooth muscles develop. In a comparative analysis, transcripts of the related sFRP1 and sFRP4 genes were frequently found in the same tissues as sFRP2 with their expression domains overlapping in some instances, but mutually exclusive in others. While sFRP1 is specifically expressed in the embryonic metanephros, eye, brain, teeth, salivary gland and small intestine, there is only weak expression of sFRP4 except for the developing teeth, eye and salivary gland. Nevertheless, sFRP genes play quite distinct roles in the morphogenesis of several organ systems.

The SEC12 disclosed in this invention is expressed in at least the following tissues: apical microvilli of the retinal pigment epithelium, arterial (aortic), basal forebrain, brain, Burkitt lymphoma cell lines, corpus callosum, cardiac (atria and ventricle), caudate nucleus, CNS and peripheral tissue, cerebellum, cerebral cortex, colon, cortical neurogenic cells, endothelial (coronary artery and umbilical vein) cells, palate epithelia, eye, neonatal eye, frontal cortex, fetal hematopoietic cells, heart, hippocampus, hypothalamus, leukocytes, liver, fetal liver, lung, lung lymphoma cell lines, fetal lymphoid tissue, adult lymphoid tissue, those that express MHC I, II, and III, nervous tissues, medulla, subthalamic nucleus, ovary, pancreas, pituitary, placenta, pons, prostate, putamen, serum, skeletal muscle, small intestine, smooth muscle (coronary artery in aortia) spinal cord, spleen, stomach, taste receptor cells of the tongue, testis, thalamus, and thymus tissue. This information was derived by determining the tissue sources of the sequences that were included in the invention including but not limited to Seq-Calling sources, public EST sources, literature sources, and/or RACE sources. Further expression data for SEC12 is provided in Example 2.

The nucleic acids and proteins of SEC12 are useful in potential therapeutic applications implicated in various SEC-related pathological disorders described further herein. The SEC12 nucleic acid encoding the frizzled-like protein of the invention, or fragments thereof, may further be useful in diagnostic applications, wherein the presence or amount of the nucleic acid or the protein are to be assessed.

These materials are further useful in the generation of antibodies that bind immunospecifically to the substances of the invention for use in therapeutic or diagnostic methods. These antibodies may be generated according to methods known in the art, using prediction from hydrophobicity charts, as described in the "Anti-SECX Antibodies" section below. The disclosed SEC12 protein has multiple hydrophilic regions, each of which can be used as an immunogen. In one embodiment, for example, a contemplated SEC12 epitope comprises from about amino acids 35 to about 65. In another embodiment, for example, a SEC12 epitope comprises from about amino acids 95 to about 135. In further embodiments, for example, a SEC12 epitope comprises from about 145 to about 258, and from about 260 to about 346.

NOVX

The present invention also provides novel nucleotides and polypeptides encoded thereby. Included in the invention are the novel nucleic acid sequences and their encoded polypeptides. The sequences are collectively referred to herein as "NOVX nucleic acids" or "NOVX polynucleotides" and the corresponding encoded polypeptides are referred to as "NOVX polypeptides" or "NOVX proteins." Unless indicated otherwise, "NOVX" is meant to refer to any of the novel sequences disclosed herein. Table A provides a summary of the NOVX nucleic acids and their encoded polypeptides.

TABLE 12G

Sequences and Corresponding SEQ ID Numbers

| NOVX Assignment | Internal Identification | SEQ ID NO (nucleic acid) | SEQ ID NO (polypeptide) | Homology |
|---|---|---|---|---|
| 1 | CG56008 | 25 | 26 | LIV-1 |
| 2 | CG56149 | 27 | 38 | NRD convertase |
| 3 | CG56155 | 29 | 30 | Kallikrein |

TABLE 12G-continued

Sequences and Corresponding SEQ ID Numbers

| NOVX Assignment | Internal Identification | SEQ ID NO (nucleic acid) | SEQ ID NO (polypeptide) | Homology |
|---|---|---|---|---|
| 4a | CG56166_01 | 31 | 32 | Multidrug transporter |
| 4b | CG56166_02 | 319 | 320 | Multidrug transporter |
| 5 | CG56151 | 33 | 34 | Glucose transporter type 2 |
| 6 | CG56690 | 35 | 36 | Frizzled homolog 9 |
| 7 | CG55117 | 37 | 38 | AC133, prominin |
| 8 | CG56006 | 39 | 40 | hepsin |

NOVX nucleic acids and their encoded polypeptides are useful in a variety of applications and contexts. The various NOVX nucleic acids and polypeptides according to the invention are useful as novel members of the protein families according to the presence of domains and sequence relatedness to previously described proteins. Additionally, NOVX nucleic acids and polypeptides can also be used to identify proteins that are members of the family to which the NOVX polypeptides belong.

NOV1 is homologous to a NRD convertase-like family of proteins. Thus, the NOV1 nucleic acids, polypeptides, antibodies and related compounds according to the invention will be useful in therapeutic and diagnostic applications implicated in, for example; cancer, especially breast, ovarian and bladder cancer, and/or other pathologies or conditions.

NOV2 is homologous to the NRD convertase-like family of proteins. Thus NOV2 nucleic acids, polypeptides, antibodies and related compounds according to the invention will be useful in therapeutic and diagnostic applications implicated in diabetes, metabolic disorders and/or other pathologies and disorders.

NOV3 is homologous to a family of kallikrein-like proteins. Thus, the NOV3 nucleic acids and polypeptides, antibodies and related compounds according to the invention will be useful in therapeutic and diagnostic applications implicated in, for example: cancer, particularly prostate cancer, metabolic disorders, heart disease, hypertension, and/or other pathologies.

NOV4 is homologous to the multidrug transporter-like family of proteins. Thus, NOV4 nucleic acids, polypeptides, antibodies and related compounds according to the invention will be useful in therapeutic and diagnostic applications implicated in, for example: cancer, especially leukemia, metabolic disorders, and/or other pathologies.

NOV5 is homologous to the glucose transporter type 2-like family of proteins. Thus NOV5 nucleic acids, polypeptides, antibodies and related compounds according to the invention will be useful in therapeutic and diagnostic applications implicated in diabetes, fetal growth retardation, cancer, glycogen storage disease, hypertension and/or other disorders and conditions.

NOV6 is homologous to the Frizzled 9-like family of proteins. Thus NOV6 nucleic acids, polypeptides, antibodies and related compounds according to the invention will be useful in therapeutic and diagnostic applications implicated in, for example: ulcerative colitis, Crohn's disease, recessive Robinow syndrome, cancer and/or other pathologies/disorders.

NOV7 is homologous to members of the prominin-like family of proteins. Thus, the NOV7 nucleic acids, polypeptides, antibodies and related compounds according to the invention will be useful in therapeutic and diagnostic applications implicated in, for example; neurological disorders, cholesterol transport disorders, retinal degeneration and/or other pathologies/disorders.

NOV8 is homologous to the hepsin-like family of proteins. Thus, NOV8 nucleic acids and polypeptides, antibodies and related compounds according to the invention will be useful in therapeutic and diagnostic applications implicated in, for example; cancer, especially prostate and ovarian cancer, and/or other pathologies/disorders.

The NOVX nucleic acids and polypeptides can also be used to screen for molecules, which inhibit or enhance NOVX activity or function. Specifically, the nucleic acids and polypeptides according to the invention may be used as targets for the identification of small molecules that modulate or inhibit, e.g., neurogenesis, cell differentiation, cell proliferation, hematopoiesis, wound healing and angiogenesis.

Additional utilities for the NOVX nucleic acids and polypeptides according to the invention are disclosed herein.

NOV1

A disclosed NOV1 nucleic acid of 3445 nucleotides designated SEQ ID NO:25 (also referred to as CG56008) encoding a human LIV-1-like protein is shown in Table 13A.

TABLE 13A

NOV1 nucleotide sequence.

(SEQ ID NO:25)
CACCGCGTGTTCGCGCCTGGTAGAGATTTCTCGAAGACACCAGTGGGCCCGTGTGGAACCAAACCTGCGCGCGTGGCCGG

GCCGTGGGACAACGAGGCCGCGGAGACGAAGGCGCAATGGCGAGGAAGTTATCTGTAATCTTGATCCTGACCTTTGCCCT

CTCTGTCACAAATCCCCTTCATGAACTAAAAGCAGCTGCTTTCCCCCAGACCACTGAGAAAATTAGTCCGAATTGGGAAT

CTGGCATTAATGTTGACTTGGCAATTTCCACACGGCAATATCATCTACAACAGCTTTTCTACCGCTATGGAGAAAATAAT

TCTTTGTCAGTTGAAGGGTTCAGAAAATTACTTCAAAATATAGGCATAGATAAGATTAAAAGAATCCATATACACCATGA

CCACGACCATCACTCAGACCACGAGCATCACTCAGACCATGAGCGTCACTCAGACCATGAGCATCACTCAGAGCACGAGC

TABLE 13A-continued

NOV1 nucleotide sequence.

ATCACTCTGACCATGATCATCACTCTCACCATAATCATGCTGCTTCTGGTAAAAATAAGCGAAAAGCTCTTTGCCCAGAC

CATGACTCAGATAGTTCAGGTAAAGATCCTAGAAACAGCCAGGGGAAAGGAGCTCACCGACCAGAACATGCCAGTGGTAG

AAGGAATGTCAAGGACAGTGTTAGTGCTAGTGAAGTGACCTCAACTGTGTACAACACTGTCTCTGAAGGAACTCACTTTC

TAGAGACAATAGAGACTCCAAGACCTGGAAAACTCTTCCCCAAAGATGTAAGCAGCTCCACTCCACCCAGTGTCACATCA

AAGAGCCGGGTGAGCCGGCTGGCTGGTAGGAAAACAAATGAATCTGTGAGTGAGCCCCGAAAAGGCTTTATGTATTCCAG

AAACACAAATGAAAATCCTCAGGAGTGTTTCAATGCATCAAAGCTACTGACATCTCATGGCATGGGCATCCAGGTTCCGC

TGAATGCAACAGAGTTCAACTATCTCTGTCCAGCCATCATCAACCAAATTGATGCTAGATCTTGTCTGATTCATACAAGT

GAAAAGAAGGCTGAAATCCCTCCAAAGACCTATTCATTACAAATAGCCTGGGTTGGTGGTTTTATAGCCATTTCCATCAT

CAGTTTCCTGTCTCTGCTGGGGGTTATCTTAGTGCCTCTCATGAATCGGGTGTTTTTCAAATTTCTCCTGAGTTTCCTTG

TGGCACTGGCCGTTGGGACTTTGAGTGGTGATGCTTTTTTACACCTTCTTCCACATTCTCATGCAAGTCACCACCATAGT

CATAGCCATGAAGAACCAGCAATGGAAATGAAAAGAGGACCACTTTTCAGTCATCTGTCTTCTCAAAACATAGAAGAAAG

TGCCTATTTTGATTCCACGTGGAAGGGTCTAACAGCTCTAGGAGGCCTGTATTTCATGTTTCTTGTTGAACATGTCCTCA

CATTGATCAAACAATTTAAAGATAAGAAGAAAAAGAATCAGAAGAAACCTGAAAATGATGATGATGTGGAGATTAAGAAG

CAGTTGTCCAAGTATGAATCTCAACTTTCAACAAATGAGGAGAAAGTAGATACAGATGATCGAACTGAAGGCTATTTACG

AGCAGACTCACAAGAGCCCTCCCACTTTGATTCTCAGCAGCCTGCAGTCTTGGAAGAAGAAGAGGTCATGATAGCTCATG

CTCATCCACAGGAAGTCTACAATGAATATGTACCCAGAGGGTGCAAGAATAAATGCCATTCACATTTCCACGATACACTC

GGCCAGTCAGACGATCTCATTCACCACCATCATGACTACCATCATATTCTCCATCATCACCACCACCAAAACCACCATCC

TCACAGTCACAGCCAGCGCTACTCTCGGGAGGAGCTGAAAGATGCCGGCGTCGCCACTCTGGCCTGGATGGTGATAATGG

GTGATGGCCTGCACAATTTCAGCGATGGCCTAGCAATTGGTGCTGCTTTTACTGAAGGCTTATCAAGTGGTTTAAGTACT

TCTGTTGCTGTGTTCTGTCATGAGTTGCCTCATGAATTAGGTGACTTTGCTGTTCTACTAAAGGCTGGCATGACCGTTAA

GCAGGCTGTCCTTTATAATGCATTGTCAGCCATGCTGGCGTATCTTGGAATCGCAACAGGAATTTTCATTCGTCATTATG

CTGAAAATGTTTCTATGTGGATATTTGCACTTACTGCTGGCTTATTCATGTATGTTGCTCTGGTTGATATGGTACCTGAA

ATGCTGCACAATGATGCTAGTGACCATGGATGTAGCCGCTGGGGGTATTTCTTTTTACAGAATGCTGGGATGCTTTTGGG

TTTTGGAATTATGTTACTTATTTCCATATTTGAACATAAAATCGTGTTTCGTATAAATTTCTAGTTAAGGTTTAAATGCT

AGAGTAGCTTAAAAAGTTGTCATAGTTTCAGTAGGTCATAGGGAGATGAGTTTGTATGCTGTACTATGCAGCGTTTAAAG

TTAGTGGGTTTTGTGATTTTTGTATTGAATATTGCTGTCTGTTACAAAGTCAGTTAAAGGTACGTTTTAATATTTAAGTT

ATTCTATCTTGGAGATAAAATCTGTATGTGCAATTCACCGGTATTACCAGTTTATTATGTAAACAAGAGATTTGGCATGA

CATGTTCTGTATGTTTCAGGGAAAAATGTCTTTAATGCTTTTTCAAGAACTAACACAGTTATTCCTATACTGGATTTTAG

GTCTCTGAAGAACTGCTGGTGTTTAGGAATAAGAATGTGCATGAAGCCTAAAATACCAAGAAAGCTTATACTGAATTTAA

GCAAAGAAATAAAGGAGAAAAGAGAAGAATCTGAGAATTGGGGAGGCATAGATTCTTATAAAAATCACAAAATTTGTTGT

AAATTAGAGGGAGAAATTTAGAATTAAGTATAAAAAGGCAGAATTAGTATAGAGTACATTCATTAAACATTTTTGTCAG

GATTATTTCCCGTAAAAACGTAGTGAGCACTTTTCATATACTAATTTAGTTGTACATTTAACTTTGTATAATACAGAAAT

CTAAATATATTTAATGAATTCAAGCAATATATCACTTGACCAAGAAATTGGAATTTCAAAATGTTCGTGCGGGTATATAC

CAGATGAGTACAGTGAGTAGTTTTATGTATCACCAGACTGGGTTATTGCCAAGTTATATATCACCAAAAGCTGTATGACT

GGATGTTCTGGTTACCTGGTTTACAAAATTATCAGAGTAGTAAAACTTTGATATATATGAGGATATTAAAACTACACTAA

GTATCATTTGATTCGATTCAGAAAGTACTTTGATATCTCTCAGTGCTTCAGTGCTATCATTGTGAGCAATTGTCTTTTAT

ATACGGTACTGTAGCCATAGTACGCCTGTCTGTGGCATTCTCTAGATGTTTCTTTTTTACACAATAAATTCCTTATATCA

GCTTG

The disclosed NOV1 polypeptide (SEQ ID NO:26) encoded by SEQ ID NO:25 has 755 amino acid residues and is presented in Table 13A using the one-letter amino acid code. Signal P, Psort and/or Hydropathy results predict that NOV1 contains a signal peptide and is likely to be localized to the plasma membrane with a certainty of 0.6400. In other embodiments, NOV1 may also be localized to the Golgi body with a certainty of 0.4600, the endoplasmic reticulum (membrane) with a certainty of 0.3700, or the endoplasmic reticulum (lumen) with a certainty of 0.1000. The most likely cleavage site for NOV1 is between positions 18 and 19: SVT-NP.

NOV1 is expressed in at least the following tissues: Adrenal gland, Aorta, Blood, Bone, Brain, Breast, Colon, Ear, Foreskin, Kidney, Lung, Ovary, Parathyroid, Placenta, Pooled, Prostate, Stomach, Testis, Thyroid, Tonsil, Uterus, Whole embryo, amnion_normal, breast, breast_normal, colon, head_neck, kidney, lung, marrow, nervous_normal, nervous_tumor, ovary, placenta, placenta_normal, prostate_tumor, skin, testis_normal, uterus, uterus_tumor. This information was derived by determining the tissue sources of the sequences that were included in the invention including but not limited to SeqCalling sources, Public EST sources, Literature sources, and/or RACE sources.

The disclosed NOV1 polypeptide has homology to the amino acid sequences shown in the BLASTP data listed in Table 13C. Public amino acid databases include the GenBank databases, SwissProt, PDB and PIR.

TABLE 13B

Encoded NOV1 protein sequence.

(SEQ ID NO:26)
MARKLSVILILTFALSVTNPLHELKAAAFPQTTEKISPNWESGINVDLAISTRQYHLQQLFYRYGENNSLSVEGFRKLLQ

NIGIDKIKRIHIHHDHDHHSDHEHHSDHERHSDHEHHSEHEHHSDHDHHSHHNHAASGKNKRKALCPDHDSDSSGKDPRN

SQGKGAHRPEHASGRRNVKDSVSASEVTSTVYNTVSEGTHFLETIETPRPGKLFPKDVSSSTPPSVTSKSRVSRLAGRKT

NESVSEPRKGFMYSRNTNENPQECFNASKLLTSHGMGIQVPLNATEFNYLCPAIINQIDARSCLIHTSEKKAEIPPKTYS

LQIAWVGGFIAISIISFLSLLGVILVPLMNRVFFKFLLSFLVALAVGTLSGDAFLHLLPHSHASHHHSHSHEEPAMEMKR

GPLFSHLSSQNIEESAYFDSTWKGLTALGGLYFMFLVEHVLTLIKQFKDKKKKNQKKPENDDDVEIKKQLSKYESQLSTN

EEKVDTDDRTEGYLRADSQEPSHFDSQQPAVLEEEEVMIAHAHPQEVYNEYVPRGCKNKCHSHFHDTLGQSDDLIHHHHD

YHHILHHHHQNHHPHSHSQRYSREELKDAGVATLAWMVIMGDGLHNFSDGLAIGAAFTEGLSSGLSTSVAVFCHELPHE

LGDFAVLLKAGMTVKQAVLYNALSAMLAYLGMATGIFIGHYAENVSMWIFALTAGLFMYVALVDMVPEMLHNDASDHGCS

RWGYFFLQNAGMLLGFGIMLLISIFEHKIVFRINF

TABLE 13C

BLAST results for NOV1

| Gene Index/ Identifier | Protein/Organism | Length (aa) | Identity (%) | Positives (%) | Expect |
|---|---|---|---|---|---|
| gi|7513131|pir| G02273 | LIV-1 protein - human | 752 | 98 | 98 | 0.0 |
| gi|14760892|ref|XP_029402.1| (XM_029402) | LIV-1 protein, estrogen regulated [Homo sapiens] | 755 | 100 | 100 | 0.0 |
| gi|12751475|ref|NP_036451.2| (NM_012319) | LIV-1 protein, estrogen regulated [Homo sapiens] | 749 | 98 | 98 | 0.0 |
| gi|14249879|gb| AAH08317.1| AAH08317 (BC008317) | Unknown (protein for IMAGE: 3343159) [Homo sapiens] | 382 | 100 | 100 | 0.0 |
| gi|505102|dbj| BAA06685.1| (D31887) | KIAA0062 [Homo sapiens] | 531 | 29 | 46 | 1e-55 |

The homology between these and other sequences is shown graphically in the ClustalW analysis shown in Table 13D. In the ClustalW alignment of the NOV1 proteins, as well as all other ClustalW analyses herein, the black outlined amino acid residues indicate regions of conserved sequence (i.e., regions that may be required to preserve structural or functional properties), whereas non-highlighted amino acid residues are less conserved and can potentially be altered to a much broader extent without altering protein structure or function.

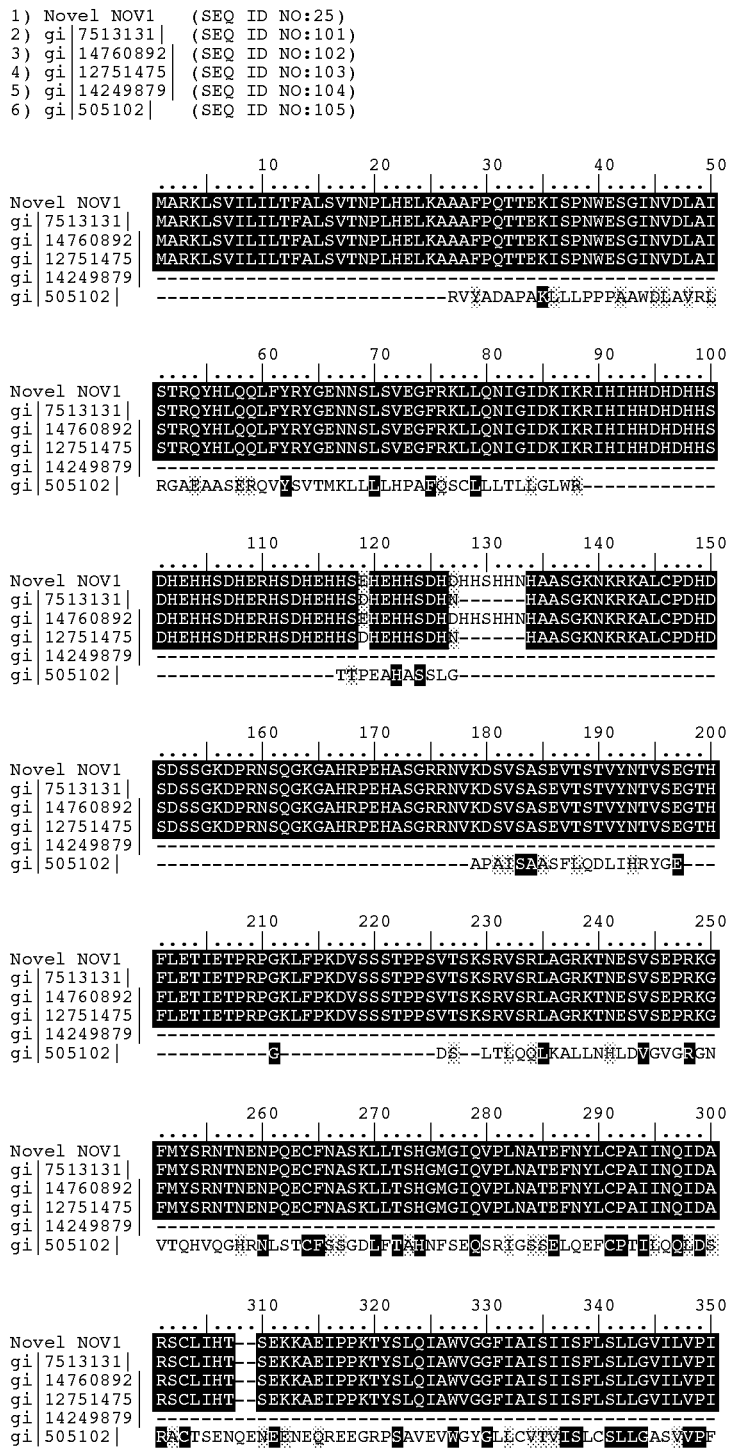

TABLE 13D

TABLE 13D-continued

ClustalW Analysis of NOV1

```
                       360       370       380       390       400
                  ....|....|....|....|....|....|....|....|....|....|
Novel NOV1        MNRVFFKFLLSFLVALAVGTLSGDAFLHLLPHSHASHHHSHSHEEPAMEM
gi|7513131|       MNRVFFKFLLSFLVALAVGTLSGDAFLHLLPHSHASHHHSHSHEEPAMEM
gi|14760892|      MNRVFFKFLLSFLVALAVGTLSGDAFLHLLPHSHASHHHSHSHEEPAMEM
gi|12751475|      MNRVFFKFLLSFLVALAVGTLSGDAFLHLLPHSHASHHHSHSHEEPAMEM
gi|14249879|      -----------------------FLHLLPHSHASHHHSHSHEEPAMEM
gi|505102|        MKKTFYKRLLLYFIALAIGTLYSNALFCLIPEAFG---------------

410       420       430       440       450
                  ....|....|....|....|....|....|....|....|....|....|
Novel NOV1        KRGPLFSHLSSQNIEESAYFDSTWKGLTALGGLYFMFLVEHVLTLIKQFK
gi|7513131|       KRGPLFSHLSSQNIEESAYFDSTWKGLTALGGLYFMFLVEHVLTLIKQFK
gi|14760892|      KRGPLFSHLSSQNIEESAYFDSTWKGLTALGGLYFMFLVEHVLTLIKQFK
gi|12751475|      KRGPLFSHLSSQNIEESAYFDSTWKGLTALGGLYFMFLVEHVLTLIKQFK
gi|14249879|      KRGPLFSHLSSQNIEESAYFDSTWKGLTALGGLYFMFLVEHVLTLIKQFK
gi|505102|        -FNPLEDYYVS-------------KSAVVFGGFYLFFFTEKILKILLKQK 460       470       480       490       500
                  ....|....|....|....|....|....|....|....|....|....|
Novel NOV1        DKKKKNQKKPENDDDVEIKKQLSKYESQLSTNEEKVDTDDRTEGYLRADS
gi|7513131|       DKKKKNQKKPENDDDVEIKKQLSKYESQLSTNEEKVDTDDRTEGYLRADS
gi|14760892|      DKKKKNQKKPENDDDVEIKKQLSKYESQLSTNEEKVDTDDRTEGYLRADS
gi|12751475|      DKKKKNQKKPENDDDVEIKKQLSKYESQLSTNEEKVDTDDRTEGYLRADS
gi|14249879|      DKKKKNQKKPENDDDVEIKKQLSKYESQLSTNEEKVDTDDRTEGYLRADS
gi|505102|        NEHHHG--------------------------------------------

510       520       530       540       550
                  ....|....|....|....|....|....|....|....|....|....|
Novel NOV1        QEPSHFDSQQPAVLEEEEVMIAHAHPQEVYNEYVPRGCKNKCHSHFHDTL
gi|7513131|       QEPSHFDSQQPAVLEEEEVMIAHAHPQEVYNEYVPRGCKNKCHSHFHDTL
gi|14760892|      QEPSHFDSQQPAVLEEEEVMIAHAHPQEVYNEYVPRGCKNKCHSHFHDTL
gi|12751475|      QEPSHFDSQQPAVLEEEEVMIAHAHPQEVYNEYVPRGCKNKCHSHFHDTL
gi|14249879|      QEPSHFDSQQPAVLEEEEVMIAHAHPQEVYNEYVPRGCKNKCHSHFHDTL
gi|505102|        --HSHYASESLPSKKDQEEGVMEKLQNGDLDHMIP----QHCSSELDGKA 560       570       580       590       600
                  ....|....|....|....|....|....|....|....|....|....|
Novel NOV1        QGSDDLIHHHHDYHHILHHHHQNHHPHSHSQRYSREELKDAGVATLAWM
gi|7513131|       QGSDDLIHHHHDYHHILHHHHQNHHPHSHSQRYSREELKDAGVATLAWM
gi|14760892|      QGSDDLIHHHHDYHHILHHHHQNHHPHSHSQRYSREELKDAGVATLAWM
gi|12751475|      QGSDDLIHHHHDYHHILHHHHQNHHPHSHSQRYSREELKDAGVATLAWM
gi|14249879|      QGSDDLIHHHHDYHHILHHHHQNHHPHSHSQRYSREELKDAGVATLAWM
gi|505102|        PMVD---------EKVIVGSLSVQDLQASQSACYWLKGVRYSDIGTLAWM 610       620       630       640       650
                  ....|....|....|....|....|....|....|....|....|....|
Novel NOV1        VIMGDGLHNFSDGLAIGAAFTEGLSSGLSTSVAVFCHELPHELGDFAVLL
gi|7513131|       VIMGDGLHNFSDGLAIGAAFTEGLSSGLSTSVAVFCHELPHELGDFAVLL
gi|14760892|      VIMGDGLHNFSDGLAIGAAFTEGLSSGLSTSVAVFCHELPHELGDFAVLL
gi|12751475|      VIMGDGLHNFSDGLAIGAAFTEGLSSGLSTSVAVFCHELPHELGDFAVLL
gi|14249879|      VIMGDGLHNFSDGLAIGAAFTEGLSSGLSTSVAVFCHELPHELGDFAVLL
gi|505102|        ITLSDGLHNFIDGLAIGASFTVSVFQGISTSVAILCEEFPHELGDFVILL 660       670       680       690       700
                  ....|....|....|....|....|....|....|....|....|....|
Novel NOV1        KAGMTVKQAVLYNALSAMLAYLGMATGIFIGHYAENVSMWIFALTAGLFM
gi|7513131|       KAGMTVKQAVLYNALSAMLAYLGMATGIFIGHYAENVSMWIFALTAGLFM
gi|14760892|      KAGMTVKQAVLYNALSAMLAYLGMATGIFIGHYAENVSMWIFALTAGLFM
gi|12751475|      KAGMTVKQAVLYNALSAMLAYLGMATGIFIGHYAENVSMWIFALTAGLFM
gi|14249879|      KAGMTVKQAVLYNALSAMLAYLGMATGIFIGHYAENVSMWIFALTAGLFM
gi|505102|        NAGMSIQQALFFNFLSACCCYLGEAFGILAGSHFS--ANWIFALAGGMFE 710       720       730       740       750
                  ....|....|....|....|....|....|....|....|....|....|
Novel NOV1        YVALVDMVPEMLHNDASDHG-CSRWGYFFLQNAGMLLGFGIMLLISIFEH
gi|7513131|       YVALVDMVPEMLHNDASDHG-CSRWGYFFLQNAGMLLGFGIMLLIPYLNI
gi|14760892|      YVALVDMVPEMLHNDASDHG-CSRWGYFFLQNAGMLLGFGIMLLISIFEH
gi|12751475|      YVALVDMVPEMLHNDASDHG-CSRWGYFFLQNAGMLLGFGIMLLISIFEH
gi|14249879|      YVALVDMVPEMLHNDASDHG-CSRWGYFFLQNAGMLLGFGIMLLISIFEH
gi|505102|        YISLADMFPEMNEVCQEDERKGSILIPFIIQNLCLLTGFTIMVVLTMVSG 760
                  ....|....|
Novel NOV1        K---IVFRINF
gi|7513131|       KSCSYKFLVKV
gi|14760892|      K---IVFRINF
gi|12751475|      K---IVFRINF
gi|14249879|      K---IVFRINF
gi|505102|        Q-----IQIG-
```

The presence of identifiable domains in NOV1, as well as all other NOVX proteins, was determined by searches using software algorithms such as PROSITE, DOMAIN, Blocks, Pfam, ProDomain, and Prints, and then determining the Interpro number by crossing the domain match (or numbers) using the Interpro website (http:www.ebi.ac.uk/interpro). DOMAIN results for NOV1 as disclosed in Tables 13K–13L, were collected from the Conserved Domain Database (CDD) with Reverse Position Specific BLAST analyses. This BLAST analysis software samples domains found in the Smart and Pfam collections. For Table 1K and all successive DOMAIN sequence alignments, fully conserved single residues are indicated by black shading or by the sign (|) and "strong". semi-conserved residues are indicated by grey shading or by the sign (+). The "strong" group of conserved amino acid residues may be any one of the following groups of amino acids: STA, NEQK, NHQK, NDEQ, QHRK, MILV, MILF, HY, FYW.

Tables 1E–F list the domain descriptions from DOMAIN analysis results against NOV1. This indicates that the NOV1 sequence has properties similar to those of other proteins known to contain this domain. Below are representative domain results. There are additional areas on NOV1a that also have homology to these Domains.

TABLE 13E

Domain Analysis of NOV1 gnl|Pfam|pfam02535, Zip, ZIP Zinc transporter CD-Length = 152 residues, 90.8% aligned Score = 134 bits (338), Expect = 1e–32

TABLE 13F

Domain Analysis of NOV1 gnl|Pfam|pfam01027, UPF0005, Uncharacterized protein family UPF0005 CD-Length = 188 residues, only 63.8% aligned Score = 36.6 bits (83), Expect = 0.005

Estrogen responses of human breast cancer cell lines have frequently been shown to be promoted by insulin. The action of insulin, and its interaction with estradiol, regulates the expression of the estrogen-induced genes, LIV-1 and pS2. Both hormones cause increases in mRNA levels of the two genes but do so by distinct mechanisms. The concentration of insulin required to produce this effect suggests that it is acting via its ability to bind to the IGF-1 receptor. Both insulin and estradiol exert their effects at the level of transcription. Induction by insulin is dependent upon continued protein synthesis whereas induction by estradiol is not. Induction by both insulin and estradiol is prevented by the pure antiestrogen. ICI 164384, indicating the requirement for an activatable estrogen receptor. Insulin does not stimulate LIV-1 expression via the androgen receptor. These results demonstrate that both estradiol and insulin can stimulate the transcription of these estrogen-inducible genes, by separate mechanisms both of which involve the estrogen receptor. (See El-Tanani et al., 1997, J. Steroid Biochem Mol. Biol. 60:269).

Investigation of the protein product of the estrogen-regulated gene LIV-1, implicated in metastatic breast cancer, has revealed 10 protein sequences of unknown function that belong to a new family with potential to control intracellular Zn2+ homeostasis. Sequence alignment highlights the similarity in transmembrane domains and extramembrane charged residues, indicating potential ion-transport ability. This family has a novel highly conserved motif of 66 residues, including a transmembrane domain and a catalytic zinc-binding sequence of zinc metalloproteases, containing conserved (indicated in bold type) proline and glutamine residues. These proteins contain more plentiful histidine-rich repeats than zinc transporters, suggesting an ability to bind or transport zinc across membranes. These 11 proteins may form a new family with the potential to control intracellular Zn2+ homeostasis. (See Taylor, 2000, IUBMB Life, 49:249).

The disclosed NOV1 nucleic acid of the invention encoding a Human LIV-1-like protein includes the nucleic acid whose sequence is provided in Table 13A or a fragment thereof. The invention also includes a mutant or variant nucleic acid any of whose bases may be changed from the corresponding base shown in Table 13A while still encoding a protein that maintains its Human LIV-1-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 0 percent of the bases may be so changed.

The disclosed NOV1 protein of the invention includes the Human LIV-1-like protein whose sequence is provided in Table 13B. The invention also includes a mutant or variant protein any of whose residues may be changed from the corresponding residue shown in Table 13B while still encoding a protein that maintains its Human LIV-1-like activities and physiological functions, or a functional fragment thereof. In the mutant or variant protein, up to about 0% percent of the residues may be so changed.

The invention further encompasses antibodies and antibody fragments, such as $F_{ab}$ or $(F_{ab})_2$, that bind immunospecifically to any of the proteins of the invention.

The above defined information for this invention suggests that this Human LIV-1-like protein (NOV1) may function as a member of a "Human LIV-1 family". Therefore, the NOV1 nucleic acids and proteins identified here may be useful in potential therapeutic applications implicated in (but not limited to) various pathologies and disorders as indicated below. The potential therapeutic applications for this invention include, but are not limited to: protein therapeutic, small molecule drug target, antibody target (therapeutic, diagnostic, drug targeting/cytotoxic antibody), diagnostic and/or prognostic marker, gene therapy (gene delivery/gene ablation), research tools, tissue regeneration in vivo and in vitro of all tissues and cell types composing (but not limited to) those defined here.

The NOV1 nucleic acids and proteins of the invention are useful in potential therapeutic applications implicated in cancer including but not limited to various pathologies and disorders as indicated below. For example, a cDNA encoding the Human LIV-1-like protein (NOV1) may be useful in gene therapy, and the Human LIV-1-like protein (NOV1) may be useful when administered to a subject in need thereof. By way of nonlimiting example, the compositions of the present invention will have efficacy for treatment of patients suffering from; cancer, especially breast, ovarian and bladder cancer, and/or other pathologies or conditions. The NOV1 nucleic acid encoding the Human LIV-1-like protein of the invention, or fragments thereof, may further be useful in diagnostic applications, wherein the presence or amount of the nucleic acid or the protein are to be assessed.

NOV1 nucleic acids and polypeptides are further useful in the generation of antibodies that bind immuno-specifically to the novel NOV1 substances for use in therapeutic or diagnostic methods. These antibodies may be generated according to methods known in the art, using prediction from hydrophobicity charts, as described in the "Anti-NOVX Antibodies" section below. The disclosed NOV1 proteins have multiple hydrophilic regions, each of which can be used as an immunogen. These novel proteins can be used in assay systems for functional analysis of various human disorders, which will help in understanding of pathology of the disease and development of new drug targets for various disorders.

NOV2

A disclosed NOV2 nucleic acid of 3851 nucleotides identified herein as SEQ ID NO: 27 (also referred to as CG56149-01) encoding a novel Human NRD convertase-like protein is shown in Table 14A.

TABLE 14A

NOV2 Nucleotide sequence.

(SEQ ID NO:27)
AGACTGGGGTGGGGGAGGGGTTCAGGCCTGTTCCCCGCGGCTGCGGCAGCACCAGGGCCGGCCGCCACCGCCTCTAGAAC

GCGGAGGAGGTGGGTCCTGGGAAGCGGGATGTCCATCGCTCCAGCTTGGTGGTGAATGCTGAGGAGAGTCACTGTTGCTG

CAGTCTGTGCCACCCGGAGGAAGTTGTGTGAGGCCGGGCGGGACGTCGCGGCGCTCTGGGGAATCGAAACGCGGGGTCGG

TGCGAAGACTCTGCTGCTGCCAGACCCTTTCCTATTCTGGCCATGCCTGGAAGGAACAAGGCGAAGTCTACCTGCAGCTG

CCCTGACCTGCAGCCCAATGGACAGGATCTGGGCGAGAACAGCCGGGTTGCCCGTCTAGGAGCGGATGAATCTGAGGAAG

AGGGACGGAGGGGGTCTCTCAGTAATGCTGGGGACCCTGAGATCGTCAAGTCTCCCAGCGACCCCAAGCAATACCGATAC

ATCAAATTACAGAATGGCCTACAGGCACTTCTGATTTCAGACCTAAGTAATATGGAAGGTAAAACAGGAAATACAACAGA

TGATGAAGAAGAGGAGGTGGAGGAAGAAGAAGAAGATGATGATGAAGATTCTGGAGCTGAAATAGAAGATGACGATG

AAGAGGGTTTTGATGATGAAGATGAGTTTGATGATGAACATGATGATGATCTTGATACTGAGGATAATGAATTGGAAGAA

TTAGAAGAGAGAGCAGAAGCTAGAAAAAAAACTACTGAAAAACAGCAATTGCAGAGCCTGTTTTTGCTGTGGTCAAAGCT

GACTGATAGACTGTGGTTTAAGTCAACTTATTCAAAAATGTCTTCAACCCTGCTGGTCGAGACAAGAAATCTTTATGGGG

TAGTTGGAGCTGAAAGCAGGTCTGCACCTGTTCAGCATTTGGCAGGATGGCAAGCGGAGGAGCAGCAGGGTGAAACTGAC

ACAGTTCTGTCTGCAGCGGCTCTTTGTGTTGGAGTTGGGAGTTTCGCTGATCCAGATGACCTGCCGGGGCTGGCACACTT

TTTGGAGCACATGGTATTCATGGGTAGTTTGAAATATCCAGATGAGAATGGATTTGATGCCTTCCTGAAGAAGCATGGGG

GTAGTGATAATGCCTCAACTGATTGTGAACGCACTGTCTTTCAGTTTGATGTCCAGAGGAAGTACTTCAAGGAAGCTCTT

GATAGATGGGCGCAGTTCTTCATCCACCCACTAATGATCAGAGATGCAATTGACCGTGAAGTTGAAGCTGTTGATAGTGA

ATATCAACTTGCAAGGCCTTCTGATGCAAACAGAAAGGAAATGTTGTTTGGAAGCCTTGCTAGACCTGGCCATCCTATGG

GAAAATTTTTTTGGGGAAATGCTGAGACGCTCAAGCATGAGCCAAGAAAGAATAATATTGATACACATGCTAGATTGAGA

GAATTCTGGATGCGTTACTACTCTTCTCATTACATGACTTTAGTGGTTCAATCCAAAGAAACACTGGATACTTTGGAAAA

GTGGGTGACTGAAATCTTCTCTCAGATACCAAACAATGGGTTACCCAGACCAAACTTTGGCCATTTAACGGATCCATTTG

ACACACCAGCATTTAACAAACTTTATAGAGTTGTTCCAATCAGAAAAATTCATGCTCTGACCATCACATGGGCACTTCCT

CCTCAACAGCAACATTACAGGGTGAAGCCACTTCATTATATATCCTGGCTGGTTGGACATGAAGGCAAAGGCAGCATTCT

TTCTTTCCTTAGGAAAAAATGCTGGGCTCTTGCACTGTTTGGTGGAAATGGTGAGACAGGATTTGAGCAAAATTCTACTT

ATTCAGTGTTCAGCATTTCTATTACATTGACTGATGAGGGTTATGAACATTTTTATGAGGTTGCTTACACTGTCTTTCTG

TATTTAAAAATGCTGCAGAAGCTAGGCCCAGAAAAAAGAATTTTTGAAGAGATTCGGAAAATTGAGGATAATGAATTTCA

TTACCAAGAACAGACAGATCCAGTTGAGTATGTGGAAAACATGTGTGAGAACATGCAGCTGTACCCATTGCAGGACATTC

TCACTGGAGATCAGCTTCTTTTTGAATACAAGCCAGAAGTCATTGGTGAAGCCTTGAATCAGCTAGTTCCTCAAAAAGCA

AATCTTGTTTTACTGTCTGGTGCTAATGAGGGAAAATGTGACCTCAAGGAGAAATGGTTTGGAACTCAATATAGTATAGA

AGATATTGAAAACTCTTGGGCTGAACTGTGGAATAGTAATTTCGAATTAAATCCAGATCTTCATCTTCCAGCTGAAAACA

AGTACATAGCCACGGACTTTACGTTGAAGGCTTTCGATTGCCCGGAAACAGAATACCCAGTTAAAATTGTGAATACTCCA

TABLE 14A-continued

NOV2 Nucleotide sequence.

```
CAAGGTTGCCTGTGGTATAAGAAAGACAACAAATTCAAAATCCCCAAAGCATATATACGTTTCCATCTAATTTCACCGTT
GATACAGAAATCTGCAGCAAATGTGGTCCTCTTTGATATCTTTGTCAATATCCTTACGCATAACCTTGCGGAACCAGCTT
ATGAAGCAGATGTGGCACAGCTGGAGTATAAACTGGCAGCTGGAGAACATGGTTTAATTATTCGAGTGAAAGGATTTAAC
CACAAACTACCTCTACTGTTTCAGCTCATTATTGACTACTTAGCTGAGTTCAATTCCACACCAGCTGTCTTTACAATGAT
AACTGAGCAGTTGAAGAAGACCTACTTTAACATCCTCATCAAGCCTGAGACTTTGGCCAAAGATGTACGGCTTTTAATCT
TGGAATATGCCCGTTGGTCTATGATTGACAAGTACCAGGCTTTGATGGACGGCCTTTCCCTTGAGTCTCTGCTGAGCTTC
GTCAAAGAATTCAAATCCCAGCTCTTTGTGGAGGGCCTGGTACAAGGGAATGTCACAAGCACAGAATCTATGGATTTCCT
GAAATATGTTGTTGACAAACTAAACTTCAAGCCTCTGGAGCAGGAGATGCCTGTGCAGTTCCAGGTGGTAGAGCTGCCCA
GTGGCCACCATCTATGCAAAGTGAAAGCTCTGAACAAGGGTGATGCCAACTCTGAAGTCACTGTGTACTACCAGTCAGGT
ACCAGGAGTCTAAGAGAATATACGCTTATGGAGCTGCTTGTGATGCACATGGAAGAACCTTGTTTTGACTTCCTTCGAAC
CAAGCAGACCCTTGGGTACCATGTCTACCCTACCTGTAGGAACACATCCGGGATTCTAGGATTTTCTGTCACTGTGGGGA
CTCAGGCAACCAAATACAATTCTGAAGTTGTTGATAAGAAGATAGAAGAGTTTCTTTCTAGCTTTGAGGAGAAGATTGAG
AACCTCACTGAAGAGGCATTCAACACCCAGGTCACAGCTCTCATCAAGCTGAAGGAGTGTGAGGATACCCACCTTGGGGA
GGAGGTGGATAGGAACTGGAATGAAGTGGTTACACAGCAGTACCTCTTTGACCGCCTTGCCCACGAGATTGAAGCACTGA
AGTCATTCTCAAAATCAGACCTGGTCAACTGGTTCAAGGCTCATAGAGGGCCAGGAAGTAAAATGCTCAGCGTTCATGTT
GTTGGGTATGGGAAGTATGAACTGGAAGAGGATGGATCCCCTTCTAGTGAGGATTCAAATTCTTCTTGTGAAGTGATGCA
GCTGACCTACCTGCCAACCTCTCCTCTCCTGGCAGATTGTATCATCCCCATTACTGATATCAGGGCTTTCACAACAACAC
TCAACCTTCTCCCCTACCATAAAATAGTCAAATAAATAAACTGCAGTCACGTTGGCCTGAAAAAAAAAAAAAAAAAAAA
AAAAAAAAAA
```

A NOV2 polypeptide (SEQ ID NO:28) encoded by SEQ ID NO:27 has 1219 amino acid residues and is presented using the one-letter code in Table 14B. Signal P, Psort and/or Hydropathy results predict that NOV2 contains no signal peptide and is likely to be localized to the endoplasmic reticulum (membrane) with a certainty of 0.5500. In other embodiments, NOV2 may also be localized to the lysosome (lumen) with a certainty of 0.1900, the microbody with a certainty of 0.1868, or the endoplasmic reticulum (lumen) with a certainty of 0.1000. The most likely cleavage site for NOV2 is between positions 18 and 19: KLC-EA.

TABLE 14B

Encoded NOV2 protein sequence.

(SEQ ID NO:28)
```
MLRRVTVAAVCATRRKLCEAGRDVAALWGIETRGRCEDSAAARPFPILAMPGRNKAKSTCSCPDLQPNGQDLGENSRVAR
LGADESEEEGRRGSLSNACDPEIVKSPSDPKQYRYIKLQNGLQALLISDLSNMEGKTGNTTDDEEEEVEEEEDDDEDS
GAEIEDDDEEGFDDEDEFDDEHDDDLDTEDNELEELEERAEARKKTTEKQQLQSLFLLWSKLTDRLWFKSTYSKMSSTLL
VETRNLYGVVGAESRSAPVQHLAGWQAEEQQGETDTVLSAAALCVGVGSFADPDDLPGLAHFLEHMVFMGSLKYPDENGF
DAFLKKHGGSDNASTDCERTVFQFDVQRKYFKEALDRWAQFFIHPLMIRDAIDREVEAVDSEYQLARPSDANRKEMLFGS
LARPGHPMGKFFWGNAETLKHEPRKNNIDTHARLREFWMRYYSSHYMTLVVQSKETLDTLEKWVTEIFEQIPNNGLPRPN
FGHLTDPFDTPAFNKLYRVVPIRKIHALTITWALPPQQQHYRVKPLHYISWLVGHEGKGSILSFLRKKCWALALFGGNGE
TGFEQNSTYSVPSISITLTDEGYEHFYEVAYTVFLYLKMLQKLGPEKRIFEETEKIEDNEFHYQEQTDPVEYVENMCENM
QLYPLQDILTGDQLLFEYKPEVIGEALNQLVPQKANLVLLSGANEGKCDLKEKWFGTQYSIEDIENSWAELWNSNFELNP
DLHLPAENKYIATDFTLKAFDCPETEYPVKIVNTPQGCLWYKKDNKFKIPKAYIRFHLISPLIQKSAANVVLFDIFVNIL
THNLAEPAYEADVAQLEYKLAAGEEGLIIFVKGFNHKLPLLFQLIIDYLAEFNSTPAVFTMITEQLKKTYFNILIKPETL
```

TABLE 14B-continued

Encoded NOV2 protein sequence.

AKDVRLLILEYARWSMIDKYQALMDGLSLFSLLSFVKEFKSQLFVEGLVQGNVTSTESMDFLKYVVDKLNFKPLEQEMPV

QFQVVELPSGHHLCKVKALWKGDANSEVTVYYQSGTRSLREYTLMELLVMEMEEPCFDFLRTKQTLGYHVYPTCRNTSGI

LGFSVTVGTQATKYNSEVVDKKIEFFLSSFEEKIENLTEEAFNTQVTALIKLKECEDTHLGEEVDRNWNEVVTQQYLFDR

LAHEIEALKSFSKSDLVNWFKAHRGPGSKMLSVHVVGYGKYELEEDGSPSSEDSNSSCEVMQLTYLPTSPLLADCIIPIT

DIRAFTTTLNLLPYHKIVK

NOV2 is localized on chromosome 1p32.2-34.4 and is expressed in at least the following tissues: multiple cancers and skeletal muscle. This information was derived by determining the tissue sources of the sequences that were included in the invention including but not limited to Seq-Calling sources, Public EST sources, and/or RACE sources.

NOV2 has homology to the amino acid sequences shown in the BLASTP data listed in Table 14C.

TABLE 14C

BLAST results for NOV2

| Gene Index/ Identifier | Protein/Organism | Length (aa) | Identity (%) | Positives (%) | Expect |
|---|---|---|---|---|---|
| ref\|NP_002516.1\| (NM_002525) | nardilysin (N-arginine dibasic convertase) 1 [Homo sapiens] | 1219 | 100 | 100 | 0.0 |
| emb\|CAA63696.1\| (X93208) | NRD2 convertase [Rattus sp.] | 1229 | 90 | 90 | 0.0 |
| ref\|XP_001517.5\| (XM_001517) | nardilysin (N-arginine dibasic convertase) [Homo sapiens] | 1017 | 99 | 99 | 0.0 |
| emb\|CAB72328.1\| (AL050343) | dJ657D16.1 (nardilysin (N-arginine dibasic convertase)) [Homo sapiens] | 862 | 99 | 99 | 0.0 |
| gb\|AAF48105.1 (AE003487) | CG2025 gene product [Drosophila melanogaster] | 1077 | 36 | 57 | e-165 |

The homology of these sequences is shown graphically in the ClustalW analysis shown in Table 14D.

TABLE 14D

ClustalW Analysis of NOV2

```
1) NOV2              (SEQ ID NO:28)
2) ref|NP_002516.1|  (SEQ ID NO:106)
3) emb|CAA63696.1|   (SEQ ID NO:107)
4) ref|XP_001517.5|  (SEQ ID NO:108)
5) emb|CAB72328.1|   (SEQ ID NO:109)
6) gb|AAF48105.1|    (SEQ ID NO:110)
```

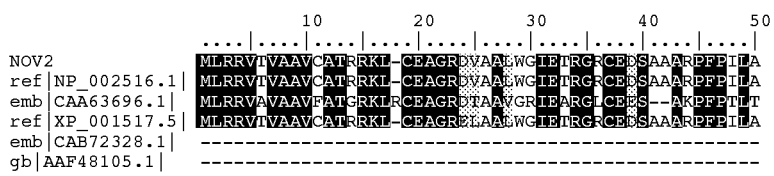

TABLE 14D-continued

ClustalW Analysis of NOV2

```
                     60         70         80         90        100
              ....|....|....|....|....|....|....|....|....|....|
NOV2          MPGRNKAKSTCSCPDLQPNGQDLGENSRVARLGADESEEEGRRGSLSNAG
ref|NP_002516.1| MPGRNKAKSTCSCPDLQPNGQDLGENSRVARLGADESEEEGRRGSLSNAG
emb|CAA63696.1|  MPGRNKAKSTCSCPDLQPNGQDLGESGRVARLGADESEEEGR--SLSNVG
ref|XP_001517.5| MPGRNKAKSTCSCPDLQPNGQDLGENSRVARLGADESEEEGRRGSLSNAG
emb|CAB72328.1|  --------------------------------------------------
gb|AAF48105.1|   ----------------------MTDQVKYLDIPD----------------

110        120        130        140        150
              ....|....|....|....|....|....|....|....|....|....|
NOV2          DPEIVKSPSDPKQYRYIKLQNGLQALLISDLSNMEGKTGNTTDDEEEEEV
ref|NP_002516.1| DPEIVKSPSDPKQYRYIKLQNGLQALLISDLSNMEGKTGNTTDDEEEEEV
emb|CAA63696.1|  DPEIIKSPSDPKQYRYIKLQNGLQALLISDLSNVEGKTGNATDDEEEEEE
ref|XP_001517.5| DPEIVKSPSDPKQYRYIKLQNGLQALLISDLSNMEGKTGNTTDDEEEEEV
emb|CAB72328.1|  --------------------------------------------------
gb|AAF48105.1|   -----KSETDKKLYKTLLGNGLHALIVSDPSPMP----------------

160        170        180        190        200
              ....|....|....|....|....|....|....|....|....|....|
NOV2          EEEE------------EDDDEDSGAEIEDDDEEGFDDEEEFDDEH--DDD
ref|NP_002516.1| EEEE------------EDDDEDSGAEIEDDDEEGFDDEEEFDDEH--DDD
emb|CAA63696.1|  EEEEGEEEEEEEDDDDDDDEDSGAEIEDDDEEGFDDEEEFDDEHDDDD
ref|XP_001517.5| EEEE------------EDDDEDSGAEIEDDDEEGFDDEEEFDDEH--DDD
emb|CAB72328.1|  --------------------------------------------------
gb|AAF48105.1|   ------------------------------HDGFTTSESSSSKS-----

210        220        230        240        250
              ....|....|....|....|....|....|....|....|....|....|
NOV2          LDTEDNELEELEERAEARKKTTEKQQLQSLFLLWSKLTDRLWFKSTYSKM
ref|NP_002516.1| LDTEDNELEELEERAEARKKTTEKQQLQSLFLLWSKLTDRLWFKSSYSKM
emb|CAA63696.1|  LDNEENELEELEERVEARKKTTEKQQSQNLFLLWSKLTDRLWFKSSYSKM
ref|XP_001517.5| LDTEDNELEELEERAEARKKTTEKQQLQSLFLLWSKLTDRLWFKSTYSKM
emb|CAB72328.1|  --------------------------------------------------
gb|AAF48105.1|   --------------------------------TVS---------------

260        270        280        290        300
              ....|....|....|....|....|....|....|....|....|....|
NOV2          SSTLLVETRNLYGVVGAESRSAPVQHLAGWQAEEQQGETDTVLSAAALCV
ref|NP_002516.1| SSTLLVETRNLYGVVGAESRSAPVQHLAGWQAEEQQGETDTVLSAAALCV
emb|CAA63696.1|  SSTLLVETRNLYGVVGAESRSAPVEHLAGWQVEEQQGETDTVLSAAALCV
ref|XP_001517.5| SSTLLVETRNLYGVVGAESRSAPVQHLAGWQAEEQQGETDTVLSAAALCV
emb|CAB72328.1|  --------------------------------------------------
gb|AAF48105.1|   ISSSIISRSESTSSTSTDSESS---------E-ESSSEEGDEKLAACATLI 310        320        330        340        350
              ....|....|....|....|....|....|....|....|....|....|
NOV2          GVGSFADPDDLPGLAHFLEHMVFMGSLKYPDENGFDAFLKKHGGSDNAST
ref|NP_002516.1| GVGSFADPDDLPGLAHFLEHMVFMGSLKYPDENGFDAFLKKHGGSDNAST
emb|CAA63696.1|  GVGSFADPDDLPGLAHFLEHMVFMGSLKYPDENGFDAFLKKHGGSDNAST
ref|XP_001517.5| GVGSFADPDDLPGLAHFLEHMVFMGSLKYPDENGFDAFLKKHGGSDNAST
emb|CAB72328.1|  --------------------------------------------------
gb|AAF48105.1|   DYGSFAEPTKYQGLAHFLEHMIFMGSEKYPKENIFDAHIKKCGGFANANT 360        370        380        390        400
              ....|....|....|....|....|....|....|....|....|....|
NOV2          DCERTVFQFDVQRKYFKEALDRWAQFFIHPLMIRDAIDREVEAVDSEYQL
ref|NP_002516.1| DCERTVFQFDVQRKYFKEALDRWAQFFIHPLMIRDAIDREVEAVDSEYQL
emb|CAA63696.1|  DCERTVFQFDVQRKYFKEALDRWAQFFIHPLMIRDAIDREVEAVDSEYQL
ref|XP_001517.5| DCERTVFQFDVQRKYFKEALDRWAQFFIHPLMIRDAIDREVEAVDSEYQL
emb|CAB72328.1|  ---------------------WAQFFIHPLMIRDAIDREVEAVDSEYQL
gb|AAF48105.1|   DCEDTLFYFEVAEKHLDSSLDYETALMKAPLMKQPAMQRERSAVDSEFQQ 410        420        430        440        450
              ....|....|....|....|....|....|....|....|....|....|
NOV2          ARPSDANRKEMLFGSLARPGHPMGKFFWGNAETLKHEPRKNNIDTHARLR
ref|NP_002516.1| ARPSDANRKEMLFGSLARPGHPMGKFFWGNAETLKHEPRKNNIDTHARLR
emb|CAA63696.1|  ARPSDANRKEMLFGSLARPGHPMGKFFWGNAETLKHEPKKNNIDTHARLR
ref|XP_001517.5| ARPSDANRKEMLFGSLARPGHPMGKFFWGNAETLKHEPRKNNIDTHARLR
emb|CAB72328.1|  ARPSDANRKEMLFGSLARPGHPMGKFFWGNAETLKHEPRKNNIDTHARLR
gb|AAF48105.1|   ILQDDETRRDQLLASLATKGFPHGTFAWGNMKSLKEN--VDDAELHKILH
```

TABLE 14D-continued

ClustalW Analysis of NOV2

```
                       460        470        480        490        500
                  ....|....|....|....|....|....|....|....|....|....|
NOV2              EFWMRYYSSHYMTLVVQSKETLDTLEKWVTEIFSQIPNNGLPRPNFC--H
ref|NP_002516.1|  EFWMRYYSSHYMTLVVQSKETLDTLEKWVTEIFSQIPNNGLPRPNFC--H
emb|CAA63696.1|   EFWMRYYSAHYMTLVVQSKETLDTLEKWVTEIFSQIPNNGLPKPNFS--H
ref|XP_001517.5|  EFWMRYYSSHYMTLVVQSKETLDTLEKWVTEIFSQIPNNGLPRPNFC--H
emb|CAB72328.1|   EFWMRYYSSHYMTLVVQSKETLDTLEKWVTEIFSQIPNNGLPRPNFC--H
gb|AAF48105.1|    EIRKEHYGANRMYVCLQARLPIDELESLVVRHFSGIPHNEVKAPDLSSFN 510        520        530        540        550
                  ....|....|....|....|....|....|....|....|....|....|
NOV2              LTDPFDTPAFNKLYRVVPIRKIHALTITWALPPQQQHYRVKPLHYISWLV
ref|NP_002516.1|  LTDPFDTPAFNKLYRVVPIRKIHALTITWALPPQQQHYRVKPLHYISWLV
emb|CAA63696.1|   LTDPFDTPAFNKLYRVVPIRKIHALTITWALPPQQQHYRVKPLHYISWLV
ref|XP_001517.5|  LTDPFDTPAFNKLYRVVPIRKIHALTITWALPPQQQHYRVKPLHYISWLV
emb|CAB72328.1|   LTDPFDTPAFNKLYRVVPIRKIHALTITWALPPQQQHYRVKPLHYISWLV
gb|AAF48105.1|    YKDAFKAEFHEQVFFVKPVENETKLELTWVLPNVRQYYRSKPDQFLSYLK 560        570        580        590        600
                  ....|....|....|....|....|....|....|....|....|....|
NOV2              GHEGKGSILSFLRKKCWALALFGGNGETGFEQNSTYSVFSISITLTDEGY
ref|NP_002516.1|  GHEGKGSILSFLRKKCWALALFGGNGETGFEQNSTYSVFSISITLTDEGY
emb|CAA63696.1|   GHEGKGSILSYLRKKCWALALFGGNGETGFEQNSTYSVFSISITLTDEGY
ref|XP_001517.5|  GHEGKGSILSFLRKKCWALALFGGNGETGFEQNSTYSVFSISITLTDEGY
emb|CAB72328.1|   GHEGKGSILSFLRKKCWALALFGGNGETGFEQNSTYSVFSISITLTDEGY
gb|AAF48105.1|    GYEGRGSLCAYLRRRLWALQLIAGIDENGFDMNSMYSSFNICIYLTDEGF 610        620        630        640        650
                  ....|....|....|....|....|....|....|....|....|....|
NOV2              EHFYEVAYTVFLYLKMLQKLGPEKRIFEEIRKIEDNEFHYQEQTDPVEYV
ref|NP_002516.1|  EHFYEVAYTVFLYLKMLQKLGPEKRIFEEIRKIEDNEFHYQEQTDPVEYV
emb|CAA63696.1|   EHFYEVAHTVFQYLKMLQKLGPEKRWFEEIQKIEDNEFHYQEQTDPVEYV
ref|XP_001517.5|  EHFYEVAYTVFQYLKMLQKLGPEKRIFEEIRKIEDNEFHYQEQTDPVEYV
emb|CAB72328.1|   EHFYEVAYTVFQYLKMLQKLGPEKRIFEEIRKIEDNEFHYQEQTDPVEYV
gb|AAF48105.1|    KNLDEVLAATFAYVKLFANCGSMKDVYEEQQRNEETGFRFHAQRPAFDNV 660        670        680        690        700
                  ....|....|....|....|....|....|....|....|....|....|
NOV2              ENMCENMQLYPLQDILTGDQLLFEYKPEVIGEALNQLVPQKANLVLLSG-
ref|NP_002516.1|  ENMCENMQLYPLQDILTGDQLLFEYKPEVIGEALNQLVPQKANLVLLSG-
emb|CAA63696.1|   ENMCENMQLYPRQDFLTGDQLLFEYKPEVIAEALNQLVPQKANLVLLSG-
ref|XP_001517.5|  ENMCENMQLYPLQDILTGDQLLFEYKPEVIGEALNQLVPQKANLVLLSG-
emb|CAB72328.1|   ENMCENMQLYPLQDILTGDQLLFEYKPEVIGEALNQLVPQKANLVLLSG-
gb|AAF48105.1|    QELVLNLKYFPKDILTGKELYYEYNEDHKELISHLNEMKFNIMVTSRR 710        720        730        740        750
                  ....|....|....|....|....|....|....|....|....|....|
NOV2              --ANEGKCDLKEKWFGTQYSIEDIENSWAELWNSNFELNPDLHLPAENKY
ref|NP_002516.1|  --ANEGKCDLKEKWFGTQYSIEDIENSWAELWNSNFELNPDLHLPAENKY
emb|CAA63696.1|   --ANEGRCDLKEKWFGTQYSIEDIENSWTELWKSNFDLNSDLHLPAENKY
ref|XP_001517.5|  --ANEGKCDLKEKWFGTQYSIEDIENSWAELWNSNFELNPDLHLPAENKY
emb|CAB72328.1|   --ANEGKCDLKEKWFGTQYSIEDIENSWAELWNSNFELNPDLHLPAENKY
gb|AAF48105.1|    KYDDISAYDKTEEWFGTEYATIPMPEKWRKLWEDSVPL-PELFLPESNKY 760        770        780        790        800
                  ....|....|....|....|....|....|....|....|....|....|
NOV2              IATDFTLKAFDCPETEYP---VKIVNTPQGCLWYKKDNKFKIPKAYIRFH
ref|NP_002516.1|  IATDFTLKAFDCPETEYP---VKIVNTPQGCLWYKKDNKFKIPKAYIRFH
emb|CAA63696.1|   IATDFTLKAFDCPETEYP---AKIVNTPQGCLWYKKDNKFKIPKAYIRFH
ref|XP_001517.5|  IATDFTLKAFDCPETEYP---VKIVNTPQGCLWYKKDNKFKIPKAYIRFH
emb|CAB72328.1|   IATDFTLKAFDCPETEYP---VKIVNTPQGCLWYKKDNKFKIPKAYIRFH
gb|AAF48105.1|    VTDDFTLHWHSMGRPEVPDSPKLLIKTDTCELWFRQDDKFDLPEAHMAFY 810        820        830        840        850
                  ....|....|....|....|....|....|....|....|....|....|
NOV2              LISPLIQKSAANVVLFDIFVNILTHNLAEPAYEADVAQLEYKLAAGEHGL
ref|NP_002516.1|  LISPLIQKSAANVVLFDIFVNILTHNLAEPAYEADVAQLEYKLAAGEHGL
emb|CAA63696.1|   LISPLIQKSAANVVLFDIFVNILTHNLAEPAYEADVAQLEYKLVAGEHGL
ref|XP_001517.5|  LISPLIQKSAANVVLFDIFVNILTHNLAEPAYEADVAQLEYKLVAGEHGL
emb|CAB72328.1|   LISPLIQKSAANVVLFDIFVNILTHNLAEPAYEADVAQLEYKLVAGEHGL
gb|AAF48105.1|    FISPMQRQNAKNDAMCSLYEEMVRFHVCEELYPAISAGLSYSLSTIEKGL
```

TABLE 14D-continued

ClustalW Analysis of NOV2

```
                    860        870        880        890        900
               ....|....|....|....|....|....|....|....|....|....|
NOV2           IIRVKGFNHKLPLLFQLIIDYLAEFNSTP--AVFTMITEQLKKTYFNILI
ref|NP_002516.1| IIRVKGFNHKLPLLFQLIIDYLAEFNSTP--AVFTMITEQLKKTYFNILI
emb|CAA63696.1|  IIRVKGFNHKLPLLFQLIIDYLTEFSSTP--AVFTMITEQLKKTYFNILI
ref|XP_001517.5| IIRVKGFNHKLPLLFQLIIDYLAEFNSTP--AVFTMITEQLKKTYFNILI
emb|CAB72328.1|  IIRVKGFNHKLPLLFQLIIDYLAEFNSTP--AVFTMITEQLKKTYFNILI
gb|AAF48105.1|   LLKVCGYNEKLHLIVEAIAEGMLNVAETLDENMLSAFVKNQRKAFNALI 910        920        930        940        950
               ....|....|....|....|....|....|....|....|....|....|
NOV2           KPETLAKDVRLLILEYARWSMIDKYQALMDGLSLESLLSFVKEFKSQLFV
ref|NP_002516.1| KPETLAKDVRLLILEYARWSMIDKYQALMDGLSLESLLSFVKEFKSQLFV
emb|CAA63696.1|  KPETLAKDVRLLILEYSRWSMIDKYRALMDGLSLESLLNFVKDFKSQLFV
ref|XP_001517.5| KPETLAKDVRLLILEYARWSMIDKYQALMDGLSLESLLSFVKEFKSQLFV
emb|CAB72328.1|  KPETLAKDVRLLILEYARWSMIDKYQALMDGLSLESLLSFVKEFKSQLFV
gb|AAF48105.1|   KPKALNRDIRLCVLERIRWLMINKYKCLSS-VILEDMREFAHQFPKELYI 960        970        980        990        1000
               ....|....|....|....|....|....|....|....|....|....|
NOV2           EGLVQGNVTSTESMDFLKYVVDKLNFKPL-EQEMPVQFQVVELPSGHHLC
ref|NP_002516.1| EGLVQGNVTSTESMDFLKYVVDKLNFKPL-EQEMPVQFQVVELPSGHHLC
emb|CAA63696.1|  EGLVQGNVTSTESMDFLRYVVDKLNFVPL-EREMPVQFQVVELPSGHHLC
ref|XP_001517.5| EGLVQGNVTSTESMDFLKYVVDKLNFKPL-EQEMPVQFQVVELPSGHHLC
emb|CAB72328.1|  EGLVQGNVTSTESMDFLKYVVDKLNFKPL-EQEMPVQFQVVELPSGHHLC
gb|AAF48105.1|   QSLIQGNYTEESAHNVMNSLLSRLNCKQIRERGRFLEDITVKLEVGTSII 1010       1020       1030       1040       1050
               ....|....|....|....|....|....|....|....|....|....|
NOV2           KVKALNKGDANSEVTVYYQSGTRSLREYTLMELLVMHMEEPCFDFLRTKQ
ref|NP_002516.1| KVKALNKGDANSEVTVYYQSGTRSLREYTLMELLVMHMEEPCFDFLRTKQ
emb|CAA63696.1|  KVRALNKGDANSEVTVYYQSGTRSLREYTLMELLVMHMEEPCFDFLRTKQ
ref|XP_001517.5| KVKALNKGDANSEVTVYYQ-----------------------VRYQE
emb|CAB72328.1|  KVKALNKGDANSEVTVYYQSGTRSLREYTLMELLVMHMEEPCFDFLRTKQ
gb|AAF48105.1|   RCHALNVQDTNTVRINFYQIGPNTVRVESIIKDLIKMFVDEPLFDQLRTKE 1060       1070       1080       1090       1100
               ....|....|....|....|....|....|....|....|....|....|
NOV2           TLGYHVYPTCRNTSGILGFSVTVGTQATKYNDEVVDKKIEEFLSSFEEKI
ref|NP_002516.1| TLGYHVYPTCRNTSGILGFSVTVGTQATKYNDEVVDKKIEEFLSSFEEKI
emb|CAA63696.1|  TLGYHVYPTCRNTSGILGFSVTVGTQATKYNDETVDKKIEEFLSSFEEKI
ref|XP_001517.5| SKRIYAYGAACDAHGRTLF--------------------------------
emb|CAB72328.1|  TLGYHVYPTCRNTSGILGFSVTVGTQATKYNDEVVDKKIEEFLSSFEEKI
gb|AAF48105.1|   QLGYHVGATVRLNYGIAGYSIMVNSQETKTTADYVEGRIEVFRAKMLQIE 1110       1120       1130       1140       1150
               ....|....|....|....|....|....|....|....|....|....|
NOV2           ENLTEEAFNTQVTALIKLKECEDTHLGEEVDRNWNEVVTQQYLFDRLAHE
ref|NP_002516.1| ENLTEEAFNTQVTALIKLKECEDTHLGEEVDRNWNEVVTQQYLFDRLAHE
emb|CAA63696.1|  ENLTEDAFNTQVTALIKLKECEDTHLGEEVDRNWNEVVTQQYLFDRLAHE
ref|XP_001517.5| --------------------------------------------------
emb|CAB72328.1|  ENLTEEAFNTQVTALIKLKECEDTHLGEEVDRNWNEVVTQQYLFDRLAHE
gb|AAF48105.1|   RHLPQDEYEHTRDSLIKLKLVADLALSTEMSRNWDEIINKSYLFDRRRRQ 1160       1170       1180       1190       1200
               ....|....|....|....|....|....|....|....|....|....|
NOV2           IEALKSFSK---SDLVNWFKAHRGPGSKMLSVHVVGYGKYELEEDGSPSS
ref|NP_002516.1| IEALKSFSK---SDLVNWFKAHRGPGSKMLSVHVVGYGKYELEEDGSPSS
emb|CAA63696.1|  IEALKSFSK---SDLVSWFKAHRGPGSKMLSVHVVGYGKYELEEDGAEVC
ref|XP_001517.5| --------------------------------------------------
emb|CAB72328.1|  IEALKSFSK---SDLVNWFKAHRGPGSKMLSVHVVGYGKYELEEDGSPSS
gb|AAF48105.1|   IEVIGHRPAGMPEPLCGEDTAKCASKSDDESESENDDDDEDEEEEESSE 1210       1220       1230       1240       1250
               ....|....|....|....|....|....|....|....|....|....|
NOV2           EDSNSS----------------CEVMQLTYLPTSPLLADCIIPITDIRAFT
ref|NP_002516.1| EDSNSS----------------CEVMQLTYLPTSPLLADCIIPITDIRAFT
emb|CAA63696.1|  EDPNS-----------------REGMQLIYLPSPLLAESTTPITDIRAFT
ref|XP_001517.5| --------------------------------------------------
emb|CAB72328.1|  EDSNSS----------------CEVMQLTYLPTSPLLADCIIPITDIRAFT
gb|AAF48105.1|   EEEEEEKEKEGLKGEDEDDLFYSENKLNIVFLPAKFNNAFIITDIEKFK
```

TABLE 14D-continued

ClustalW Analysis of NOV2

```
                        1260       1270       1280
                   ....|....|....|....|....|....|.
NOV2               TTLNLLPYHKIVK-------------------
ref|NP_002516.1|   TTLNLLPYHKIVK-------------------
emb|CAA63696.1|    ATLSLFPYHKIVK-------------------
ref|XP_001517.5|   --------------------------------
emb|CAB72328.1|    TTLNLLPYHKIVK-------------------
gb|AAF48105.1|     DDQYVYPQQKTQPKEEDELISAHIADAIRQV
```

Table 14E lists the domain description from DOMAIN analysis results against NOV2. This indicates that the NOV2 sequence has properties similar to those of other proteins known to contain this domain.

TABLE 14E

Domain Analysis of NOV2 gnl|Pfam|pfam00675, Peptidase_M16, Insulinase (Peptidase family M16).
CD-Length = 149 residues, 91.9% aligned Score = 139 bits (349),
Expect = 1e-33

N-arginine dibasic convertase (NRD convertase) (accession number L27124) is a metalloendopeptidase from rat brain cortex and testis which cleaves peptide substrates on the N-terminus of arginine residues in basic doublets. Its predicted amino acid sequence contains a putative zinc binding motif in a region which exhibits 35% and 48% similarity with E coli protease III (pitrilysin E.C 3.4.99.44) and rat or human insulinase (E.C 3.4.99.45) respectively. This feature clearly classifies this endopeptidase as a member of the pitrilysin family of zinc-metalloproteases. However, the NRD convertase sequence contains a distinctive additional feature consisting of a 71 acidic amino acid stretch. Its substrate selectivity and the characteristic motifs of its amino acid sequence allow us to propose this new metalloendopeptidase as the first member of a new class of processing enzymes. (See Chesneau et al., 1994, Biochimie 76:234).

Heparin-binding epidermal growth factor-like growth factor (HB-EGF), a mitogen and chemotactic factor, binds to two receptor tyrosine kinases, erbB1 and erbB4. Now we demonstrate that HB-EGF also binds to a novel 140 kDa receptor on MDA-MB 453 cells. Purification of this receptor showed it to be identical to N-arginine dibasic convertase (NRDc), a metalloendopeptidase of the M16 family. Binding to cell surface NRDc and NRDc in solution was highly specific for HB-EGF among EGF family members. When overexpressed in cells, NRDc enhanced their migration in response to HB-EGF but not to EGF. Conversely, inhibition of endogenous NRDc expression in cells by antisense morpholino oligonucleotides inhibited HB-EGF-induced cell migration. Anti-erbB1 neutralizing antibodies completely abrogated the ability of NRDc to enhance HB-EGF-dependent migration, demonstrating that this NRDc activity was dependent on erbB1 signaling. Although NRDc is a metalloproteinase, enzymatic activity was not required for HB-EGF binding or enhancement of cell migration; neither did NRDc cleave HB-EGF. Together, these results suggest that NRDc is a novel specific receptor for HB-EGF that modulates HB-EGF-induced cell migration via erbB1. (See Nishi et al., 2001, EMBO J 20:3342).

The disclosed NOV2 nucleic acid of the invention encoding a Human NRD convertase-like protein includes the nucleic acid whose sequence is provided in Table 14A or a fragment thereof. The invention also includes a mutant or variant nucleic acid any of whose bases may be changed from the corresponding base shown in Table 14A while still encoding a protein that maintains its Human NRD convertase-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 0 percent of the bases may be so changed.

The disclosed NOV2 protein of the invention includes the Human NRD convertase-like protein whose sequence is provided in Table 14B. The invention also includes a mutant or variant protein any of whose residues may be changed from the corresponding residue shown in Table 14B while still encoding a protein that maintains its Human NRD convertase-like activities and physiological functions, or a functional fragment thereof. In the mutant or variant protein, up to about 0 percent of the residues may be so changed.

The NOV2 nucleic acids and proteins of the invention are useful in potential therapeutic applications implicated in diabetes, metabolic disorders and/or other pathologies and disorders.

NOV2 nucleic acids and polypeptides are further useful in the generation of antibodies that bind immunospecifically to the novel substances of the invention for use in therapeutic or diagnostic methods. These antibodies may be generated according to methods known in the art, using prediction from hydrophobicity charts, as described in the "Anti-NOVX Antibodies" section below. The disclosed NOV2 protein has multiple hydrophilic regions, each of which can be used as an immunogen. These novel proteins can be used in assay systems for functional analysis of various human disorders, which are useful in understanding of pathology of the disease and development of new drug targets for various disorders.

NOV3

A disclosed NOV3 nucleic acid of 2038 nucleotides identified herein as SEQ ID NO:29 (also referred to as CG55155-01) encoding a novel Kallikrein-like protein is shown in Table 15A.

TABLE 15A

NOV3 Nucleotide Sequence (SEQ ID NO:29)
GTTTCAGAATGATTTTATTCAAGCAAGCAACTTATTTCATTTCCTTGTTTGCTACAGTTTCCTGTGGATGTCTGACTCA

ACTCTATGAAAACGCCTTCTTCAGAGGTGGGGATGTAGCTTCCATGTACACCCCAAATGCCCAATACTGCCAGATGAGGT

GCACATTCCACCCAAGGTGTTTGCTATTCAGTTTTCTTCCAGCAAGTTCAATCAATGACATGGAGAAAAGGTTTGGTTGC

TTCTTGAAAGATAGTGTTACAGGAACCCTGCCAAAAGTACATCGAACAGGTGCAGTTTCTGGACATTCCTTGAAGCAATG

TGGTCATCAAATAAGTGCTTGCCATCGAGACATTTATAAAGGAGTTGATATGAGAGGAGTCAATTTTAATGTGTCTAAGG

TTAGCAGTGTTGAAGAATGCCAAAAAAGGTGCACCAATAACATTCGCTGCCAGTTTTTTCATATGCCACGCAAACATTT

CACAAGGCAGAGTACCGGAACAATTGCCTATTAAAGTACAGTCCCGGAGGAACACCTACCGCTATAAAGGTGCTGAGTAA

CGTGGAATCTGGATTCTCACTGAAGCCCTGTGCCCTTTCAGAAATTGGTTGCCACATGAACATCTTCCAGCATCTTGCGT

TCTCAGATGTGGATGTTGCCAGGTTTCTCACTCCAGATGCTTTTGTGTGTCGGACCATCTGCACCTATCACCCCAACTGC

CTCTTCTTTACATTCTATACAAATGTATGGAAAATCGAGTCACAAAGAAATGTTTGTCTTCTTAAAACATCTGAAAGTGG

CACACCAAGTTCCTCTACTCCTCAAGAAAACACCATATCTGGATATAGCCTTTTAACCTGCAAAAGAACTTTACCTGAAC

CCTGCCATTCTAAAATTTACCCGGGAGTTGACTTTGGAGGAGAAGAATTGAATGTGACTTTTGTTAAAGGAGTGAATGTT

TGCCAAGAGACTTGCACAAAGATGATTCGCTGTCAGTTTTTCACTTATTCTTTACTCCCAGAAGACTGTAAGGAAGAGAA

GTGTAAGTGTTTCTTAAGATTATCTATGGATGGTTCTCCAACTAGGATTGCGTATGGGACACAAGGGAGCTCTGGTTACT

CTTTGAGATTGTGTAACACTGGGGACAACGCTGTCTGCACAACAAAAACAAGCACACGCATTGTTGGAGGAACAAACTCT

TCTTGGGGAGAGTGGCCCTGGCAGGTGAGCCTGCAGGTGAAGCTGACAGCTCAGAGGCACCTGTGTGGAGGGTCACTCAT

AGGACACCAGTGGGTCCTCACTGCTGCCCACTGCTTTGATGGGCTTCCCCTGCAGGATGTTTGGCGCATCTATAGTGGCA

TTTTAAATCTGTCAGACATTACAAAAGATACACCTTTCTCACAAATAAAAGAGATTATTATTCACCAAAACTATAAAGTC

TCAGAAGGGAATCATGATATCGCCTTGATAAAACTCCAGGCTCCTTTGAATTACACTGAATTCCAAAAACCAATATGCCT

ACCTTCCAAAGGTGACACAAGCACAATTTATACCAACTGTTGGGTAACCGGATGGGCTTCTCGAAGGAGAAAGGTGAAA

TCCAAAATATTCTACAAAAGGTAAATATTCCTTTGGTAACAAATGAAGAATGCCAGAAAAGATATCAAGATTATAAAATA

ACCCAACGGATGGTCTGTGCTGGCTATAAAGAAGGGGGAAAAGATGCTTGTAAGGGAGATTCAGGTGGTCCCTTAGTTTG

CAAACACAACGGAATGTGGCGTTTGGTGGGCATCACCAGCTGGGGTGAAGGCTGTGCCCGCAGGGAGCAACCTGGTGTCT

ACACCAAAGTCGCTGAGTACATGGACTGGATTTTAGAGAAAACACAGAGCAGTGATGGAAAAGCTCAGATGCAGTCACCA

GCATGAGAAGCAGTCCAGAGTCTAGGCAATTTTTACAACCTGAGTTCAAGTCAAATTCTGAGCCTGGGGGGTCCTCATCT

GCAAAGCATGAAGAGTGGCATCTTCTTTGCATCCTAAG

A disclosed NOV3 protein (SEQ ID NO:30) encoded by SEQ ID NO:29 has 638 amino acid residues, and is presented using the one-letter code in Table 15B. Signal P, Psort and/or Hydropathy results predict that NOV3 does have a signal peptide, and is likely to be localized extracellularly with a certainty of 0.3700. In other embodiments NOV3 is also likely to be localized to the lysosome (lumen) with a certainty of 0.1900, to the endoplasmic reticulum (membrane) with a certainty of 0.1000, or to the endoplasmic reticulum (lumen) with a certainty of 0.1000. The most likely cleavage site for NOV3 is between positions 19 and 20, (VSC-GC).

TABLE 15B

Encoded NOV3 protein sequence.

(SEQ ID NO:30)
MILFKQATYFISLFATVSCGCLTQLYENAFFRGGDVASMYTPNAQYCQMRCTFHPRCLLFSFLPASSINDMEKRFGCFLK

DSVTGTLPKVHRTGAVSGHSLKQCGHQISACHRDIYKGVDMRGVNFNVSKVSSVEECQKRCTNNIRCQFFSYATQTFHKA

EYRNNCLLKYSPGGTPTAIKVLSNVESGFSLKPCALSEIGCHMNIFQHLAFSDVDVARFLTPDAFVCRTICTYHPNCLFF

TFYTNVWKIESQRNVCLLKTSESGTPSSSTPQENTISGYSLLTCKRTLPEPCHSKIYPGVDFGGEELNVTFVKGVNVCQE

TABLE 15B-continued

Encoded NOV3 protein sequence.

TCTKMIRCQFFTYSLLPEDCKEEKCKCFLRLSMDGSPTRIAYGTQGSSGYSLRLCNTGDNAVCTTKTSTRIVGGTNSSWG

EWPWQVSLQVKLTAQRHLCGGSLIGHQWVLTAAHCFDGLPLQDVWRIYSGILNLSDITKDTPFSQIKEIIIHQNYKVSEG

NHDIALIKLQAPLNYTEFQKPICLPSKGDTSTIYTNCWVTGWGFSKEKGEIQNILQKVNIPLVTNEECQKRYQDYKITQR

MVCAGYKEGGKDACKGDSGGPLVCKHNGMWRLVGITSWGEGCARREQPGVYTKVAEYMDWILEKTQSSDGKAQMQSPA

NOV3 is localized on chromosome 4 and is expressed in at least the following tissues: liver. This information was derived by determining the tissue sources of the sequences that were included in the invention including but not limited to SeqCalling sources, Public EST sources, and/or RACE sources.

NOV3 has homology to the amino acid sequences shown in the BLASTP data listed in Table 15C.

TABLE 15C

BLAST results for NOV3

| Gene Index/ Identifier | Protein/ Organism | Length (aa) | Identity (%) | Positives (%) | Expect |
|---|---|---|---|---|---|
| ref\|NP_000883.1\| (NM_000892) | plasma kallikrein B1 precursor | 638 | 99 | 99 | 0.0 |
| ref\|XP_003474.2\| (XM_003474) | plasma kallikrein B1 precursor [Homo sapiens] | 638 | 98 | 98 | 0.0 |
| dbj\|BAA37147.1\| (AB022425) | kallikrein [Sus scrofa] | 643 | 79 | 89 | 0.0 |
| ref\|NP_032481.1\| (NM_008455) | kallikrein B, plasma 1; kallikrein 3, plasma; antigen, prostate specific [Mus musculus] | 638 | 76 | 86 | 0.0 |
| ref\|NP_036857.1\| (NM_012725) | plasma kallikrein [Rattus norvegicus] | 638 | 74 | 85 | 0.0 |

The homology of these sequences is shown graphically in the ClustalW analysis shown in Table 15D.

TABLE 15D

ClustalW Analysis of NOV3

1) NOV3a              (SEQ ID NO:30)
2) ref|NP_000883.1|   (SEQ ID NO:111)
3) ref|XP_003474.2|   (SEQ ID NO:112)
4) dbj|BAA37147.1|    (SEQ ID NO:113)
5) ref|NP_032481.1|   (SEQ ID NO:114)
6) ref|NP_036857.1|   (SEQ ID NO:115)

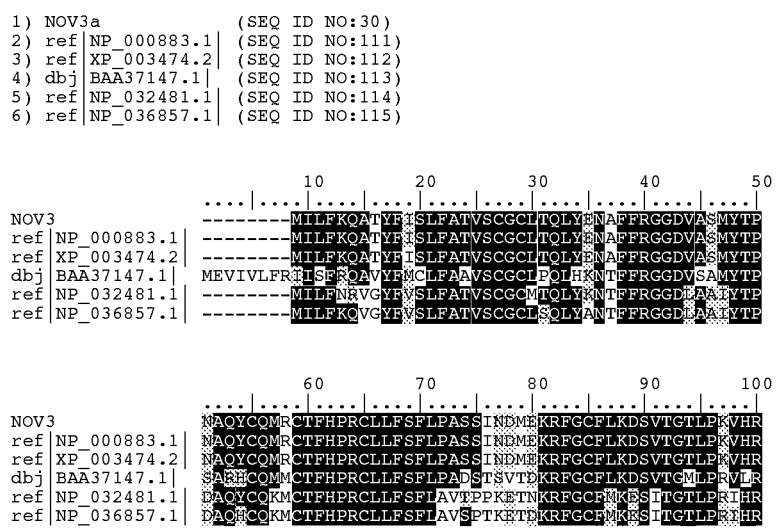

TABLE 15D-continued

ClustalW Analysis of NOV3

```
                         110       120       130       140       150
                    ....|....|....|....|....|....|....|....|....|....|
NOV3                TGAVSGHSLKQCGHQISACHRDIYKGVDMRGVNFNVSKVSSVEECQKRCT
ref|NP_000883.1|    TGAVSGHSLKQCGHQISACHRDIYKGVDMRGVNFNVSKVSSVEECQKRCT
ref|XP_003474.2|    TGAVSGHSLKQCGHQISACHRDIYKGVDMRGVNFNVSKVSSVEECQKRCT
dbj|BAA37147.1|     ENAISGHSLKQCGHQIRACHRDIYKGIDMRGVNFNVSKVKTVEECQERCT
ref|NP_032481.1|    TGAISGHSLKQCGHQISACHRDIYKGLDMRGSNFNTSKTDNIEECQKLCT
ref|NP_036857.1|    TGAISGHSLKQCGHQISACHQDIYEGLDMRGSNFNTSKTDNIEECQKLCT 160       170       180       190       200
                    ....|....|....|....|....|....|....|....|....|....|
NOV3                NNIRCQFFSYATQTFHKAEYRNNCLLKYSPGGTPTAIKVISNVESGFSLK
ref|NP_000883.1|    NNIRCQFFSYATQTFHKAEYRNNCLLKYSPGGTPTAIKVISNVESGFSLK
ref|XP_003474.2|    NNIRCQVFSYAPHTFHKXXXXXNNCLLKYSPGGTPTAIKVISNVESGFSLK
dbj|BAA37147.1|     NSIHCLFFTYATQAFNNAEYRPEYRKKCLLKHSASGTPTSIKVIANVESGFSLK
ref|NP_032481.1|    NNFHCQFFTYATSAFYRPEYRKKCLLKHSASGTPTSIKSADNLVSGFSLK
ref|NP_036857.1|    NNIHCQFFTYATKAFHRPEYRKSCLLKRSSSGTPTSIKPVDNLVSGFSLK 210       220       230       240       250
                    ....|....|....|....|....|....|....|....|....|....|
NOV3                PCALSEIGCHMNIFQHLAFSDVDVARFLTPDAFVCRTICTYHPNCLFFTF
ref|NP_000883.1|    PCALSEIGCHMNIFQHLAFSDVDVARVLTPDAFVCRTICTYHPNCLFFTF
ref|XP_003474.2|    PCALSEIGCHMNIFQHLAFSDVDVARVLTPDAFVCRTICTYHPNCLFFTF
dbj|BAA37147.1|     PCADSEIGCHMDIFQHLAFSDVDVARVIAPDAFVCRTICTYHPNCLFFTF
ref|NP_032481.1|    SCALSEIGCPMDIFQHSAFADENVSQVITPDAFVCRTICTEHPNCLFFTF
ref|NP_036857.1|    SCALSEIGCPMDIFQHFAFADLNVSQVVTPDAFVCRTVCTEHPNCLFFTF 260       270       280       290       300
                    ....|....|....|....|....|....|....|....|....|....|
NOV3                YTNVWKIESQRNVCLLKTSESGTPSSSTPQENTISGYSLLTCKRTLPEPC
ref|NP_000883.1|    YTNVWKIESQRNVCLLKTSESGTPSSSTPQENTISGYSLLTCKRTLPEPC
ref|XP_003474.2|    YTNVWKIESQRNVCLLKTSESGTPSSSTPQENTISGYSLLTCKRTLPEPC
dbj|BAA37147.1|     YTNAWKIESQRNVCLLKTSESGTPSSFPTPENAISGYSLLTCKQTLPEPC
ref|NP_032481.1|    YTNEWETESQRNVCFLKTSKSGRPSPPIPQENAISGYSLLTCKRTRPEPC
ref|NP_036857.1|    YTNEWETESQRNVCFLKTSKSGRPSPPIIQENAVSGYSLFTCKRKARPEPC 310       320       330       340       350
                    ....|....|....|....|....|....|....|....|....|....|
NOV3                HSKIYPGVDFGGEELNVTFVKGVNVCQETCTKMIRCQFFTYSLLPEDCKE
ref|NP_000883.1|    HSKIYPGVDFGGEELNVTFVKGVNVCQETCTKMIRCQFFTYSLLPEDCKE
ref|XP_003474.2|    HSKIYPGVDFGGEELNVTFVKGVNVCQETCTKMIRCQFFTYSLLPEDCKE
dbj|BAA37147.1|     HSKIYSEVDFEGEELNVTFVQGANLCQETCTKTIRCQFFTYSLHPEDCRG
ref|NP_032481.1|    HSKIYSGVDFEGEELNVTFVQGADVCQETCTKTIRCQFFITYSLLPQDCKE
ref|NP_036857.1|    HFKIYSGVAFEGEELNATFVQGADACQETCTKTIRCQFFTYSLLPQDCKA 360       370       380       390       400
                    ....|....|....|....|....|....|....|....|....|....|
NOV3                EKCKCFLRLSMDGSPTRIAYGTQGSSGYSLRLCNTGDNAVCTTKTSTRIV
ref|NP_000883.1|    EKCKCFLRLSMDGSPTRIAYGTQGSSGYSLRLCNTGDNSVCTTKTSTRIV
ref|XP_003474.2|    EKCKCFLRLSMDGSPTRIAYGTQGSSGYSLRLCNTGDNSVCTTKTSTRIV
dbj|BAA37147.1|     EKCKCSLRLSSDGSPTKITHGMRASSGYSLRLCRSGDHSACATKANTRIV
ref|NP_032481.1|    EGCKCSLRLSTDGSPTRITYCMQGSSGYSLRLCKLVDSPDCTTKINARIV
ref|NP_036857.1|    EGCKCSLRLSTDGSPTRITYEAQGSSGYSLRLCKVVESSDCTTKINARIV 410       420       430       440       450
                    ....|....|....|....|....|....|....|....|....|....|
NOV3                GGTNSSWGEWPWQVSLQVKLTAQRHLCGGSLIGHQWVLTAAHCFDGLPLQ
ref|NP_000883.1|    GGTNSSWGEWPWQVSLQVKLTAQRHLCGGSLIGHQWVLTAAHCFDGLPLQ
ref|XP_003474.2|    GGTNSSWGEWPWQVSLQVKLTAQRHLCGGSLIGHQWVLTAAHCFDGLPLQ
dbj|BAA37147.1|     GGIDSFLGEWPWQVSLQAKLRAQNHLCGGSIIGHQWVLTAAHCFDGLSLP
ref|NP_032481.1|    GGTNASLGEWPWQVSLQVKLVSQTHLCGGSIIGRQWVLTAAHCFDGIPYP
ref|NP_036857.1|    GGTNSSLGEWPWQVSLQVKLVSQNHNCGGSIIGRQWVLTAAHCFDGIPYP 460       470       480       490       500
                    ....|....|....|....|....|....|....|....|....|....|
NOV3                DVWRIYSGILNLSDITKDTPFSQIKEIIIHQNYKVSEGNHDIALIKLQAP
ref|NP_000883.1|    DVWRIYSGILNLSDITKDTPFSQIKEIIIHQNYKVSEGNHDIALIKLQAP
ref|XP_003474.2|    DVWRIYSGILNLSDITKDTPFSQIKEIIIHQNYKVSEGNHDIALIKLQAP
dbj|BAA37147.1|     DIWRIYGGILNISEITKETPFSQVKEIIIHQEYKILESGHDIALKKLETP
ref|NP_032481.1|    DVWRIYGGILSLSEITKETPSSRIKELIIHQEYKVSEGNYDIALIKLQTP
ref|NP_036857.1|    DVWRIYGGILNLSEITNKTPFSSIKELIIHQKYKMSEGSYDIALIKLQTP 510       520       530       540       550
                    ....|....|....|....|....|....|....|....|....|....|
NOV3                LNYTEFQKPICLPSKGDTSTIYTNCWVTGWGFSKEKGEIQNILQKVNIPL
ref|NP_000883.1|    LNYTEFQKPICLPSKGDTSTIYTNCWVTGWGFSKEKGEIQNILQKVNIPL
ref|XP_003474.2|    LNYTEFQKPICLPSKGDTSTIYTNCWVTGWGFSKEKGEIQNILQKVNIPL
dbj|BAA37147.1|     LNYTEFQKPICLPSRDDTNVVYTNCWVTGWFTEEKGEIQNILQKVNIPL
ref|NP_032481.1|    LNYTEFQKPICLPSKADTNTIYTNCWVTGWGYTKEQGETQNILQKATIPL
ref|NP_036857.1|    LNYTEFQKPICLPSKADTNTIYTNCWVTGWGYTKERGETQNILQKATIPL
```

TABLE 15D-continued

ClustalW Analysis of NOV3

```
                     560       570       580       590       600
                ....|....|....|....|....|....|....|....|....|....|
NOV3            VTNEECQKRYCDYKITQRMVCAGYKEGGKDACKGDSGGPLVCKHNGMWRL
ref|NP_000883.1|VTNEECQKRYCDYKITQRMVCAGYKEGGKDACKGDSGGPLVCKHNGMWRL
ref|XP_003474.2|VTNEECQKRYQDYKITQRMVCAGYKEGGKDACKGDSGGPLVCKHNGMWRL
dbj|BAA37147.1| VSNEECQKSYRDHKISKQMICAGYKEGGKDACKGSGGGPLVCKYNGIWHL
ref|NP_032481.1|VPNEECQKKYRDYVINKQMICAGYKEGGTDACKGDSGGPLVCKHSGRWQL
ref|NP_036857.1|VPNEECQKKYRDYVLTKQMICAGYKEGGIDACKGDSGGPLVCKHSGRWQL 610       620       630       640
                ....|....|....|....|....|....|....|....|....|.
NOV3            VGITSWGEGCARREQPGVYTKVAEYMDWILEKTQSSDGKAQMQSPA
ref|NP_000883.1|VGITSWGEGCARREQPGVYTKVAEYMDWILEKTQSSDGKAQMQSPA
ref|XP_003474.2|VGITSWGEGCARREQPGVYTKVAEYMDWILETTQSSDGKAQMQSPA
dbj|BAA37147.1| VGTTSWGEGCARREQPGVYTKVIEYMDWILEKTQDDDGQSWMK---
ref|NP_032481.1|VGITSWGEGCGRKDQPGVYTKVSEYMDWILEKTQSSDVRALETSSA
ref|NP_036857.1|VGITSWGEGCARKEQPGVYTKVAEYIDWILEKIQSSKERALETSPA
```

Tables 15E-G list the domain descriptions from DOMAIN analysis results against NOV3. This indicates that the NOV3a sequence has properties similar to those of other proteins known to contain this domain.

TABLE 15E

Domain Analysis of NOV3 gnl|Smart|smart00020, Tryp_SPc, Trypsin-like serine protease CD-Length = 230 residues,
100.0% aligned Score = 269 bits (687), Expect = 4e-73

TABLE 15F

Domain Analysis of NOV3 gnl|Smart|smart00223, APPLE, APPLE domain CD-Length = 83 residues,
100.0% aligned Score = 110 bits (276), Expect = 2e-25

TABLE 15G

Domain Analysis of NOV3 gnl|Pfam|pfam00024, PAN, PAN domain CD-Length = 78 residues,
94.9% aligned Score = 44.3 bits (103), Expect = 2e-05

The human tissue kallikrein gene family was, until recently, thought to consist of only three genes. Two of these human kallikreins, prostate-specific antigen and human glandular kallikrein 2, are currently used as valuable biomarkers of prostatic carcinoma. More recently, new kallikrein-like genes have been discovered. It is now clear that the human tissue kallikrein gene family contains at least 15 genes. All genes share important similarities, including mapping at the same chromosomal locus (19q 13.4), significant homology at both the nucleotide and protein level, and similar genomic organization. All genes encode for putative serine proteases and most of them are regulated by steroid hormones. Recent data suggest that at least a few of these kallikrein genes are connected to malignancy. (See Yousef et al., 2001, Endocr Rev 22:184).

The disclosed NOV3 nucleic acid of the invention encoding a Kallikrein-like protein includes the nucleic acid whose sequence is provided in Table 15A or a fragment thereof. The invention also includes a mutant or variant nucleic acid any of whose bases may be changed from the corresponding base shown in Table 15A while still encoding a protein that maintains its Kallikrein-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 0 percent of the bases may be so changed.

The disclosed NOV3 protein of the invention includes the Kallikrein-like protein whose sequence is provided in Table 15B. The invention also includes a mutant or variant protein any of whose residues may be changed from the corresponding residue shown in Table 15B while still encoding a protein that maintains its Kallikrein-like activities and physiological functions, or a functional fragment thereof. In the mutant or variant protein, up to about 0 percent of the residues may be so changed.

The protein similarity information, expression pattern, and map location for the Kallikrein-like protein and nucleic acid (NOV3) disclosed herein suggest that NOV3 may have important structural and/or physiological functions characteristic of the kallikrein-like family. Therefore, the NOV3 nucleic acids and proteins of the invention are useful in potential diagnostic and therapeutic applications. These include serving as a specific or selective nucleic acid or protein diagnostic and/or prognostic marker, wherein the presence or amount of the nucleic acid or the protein are to be assessed, as well as potential therapeutic applications such as the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/gene ablation), and (v) a composition promoting tissue regeneration in vitro and in vivo.

The NOV3 nucleic acids and proteins of the invention are useful in potential diagnostic and therapeutic applications implicated in various diseases and disorders described below. For example, the compositions of the present invention will have efficacy for treatment of patients suffering from cancer, particularly prostate cancer, metabolic disorders, heart disease, hypertension, and/or other pathologies.

NOV3 nucleic acids and polypeptides are further useful in the generation of antibodies that bind immunospecifically to the novel substances of the invention for use in therapeutic or diagnostic methods. These antibodies may be generated according to methods known in the art, using prediction from hydrophobicity charts, as described in the "Anti-NOVX Antibodies" section below. For example the disclosed NOV3 protein have multiple hydrophilic regions, each of which can be used as an immunogen. This novel protein also has value in development of powerful assay system for functional analysis of various human disorders, which will help in understanding of pathology of the disease and development of new drug targets for various disorders.

NOV4

The NOV4 of the invention includes two disclosed Multidrug transporter-like proteins. These proteins are referred to as NOV4a and NOV4b.

NOV4a

A disclosed NOV4a nucleic acid of 1094 nucleotides identified as SEQ ID NO:31 (designated CuraGen Acc. No. CG56166-01) encoding a novel Multidrug transporter-like protein is shown in Table 16A.

TABLE 16A

NOV4a Nucleotide Sequence (SEQ ID NO:31)
TCTTCCACCTTTCTCCATTCCTCTAGGTGCTTTTTCTGAACCTGGATGTGAGGCATTAAAGGATCCGACGGAAATAGAAT

TGAAGGCATTCTAAAATGGCTAACCGTACAGTGAAGGATGCGCACAGCATCCATGGCACCAACCCTCAATATCTGGTGGA

GAAGATCATTCGAACGCGAATCTATGAGTCCAAGTACTGGAAAGAGGAGTGCTTTGGACTTACAGCTGAACTTGTAGTCG

ATAAAGCCATGGAGTTAAGGTTTGTGGGTGGCGTCTATGGTGGCAACATAAAACCAACACCCTTTCTGTGTTTAACCTTG

AAGATGCTTCAAATTCAACCCGAGAAGGATATCATTGTAGAGTTTATCAAAAATGAAGATTTCAAGTATCTCCGCATGCT

GGGGGCACTTTACATGAGGCTGACAGGCACTGCAATTGATTGCTACAAGTACTTGGAACCTTTGTACAATGACTATCGAA

AAATCAAGAGCCAGAACCGAAATCCGGAGTTTGAATTGATGCATGTTGATGAGTTTATTGATGAACTATTGCAAAGTGAG

AGAGTCTGTGATATCATTCTGCCCCGACTACAGAAACGCTATGTATTAGAGGAAGCTGAGCAACTGGAGCCTCGAGTTAG

TGCTCTGGAAGAGGACATGGATGATGTGGAGTCCAGTGAAGAGGAAGAAGAGGAGGTAGAGAAGTTGGAAAGAGTGCCAT

CACCTGATCACCGCCGGACAAGCTACCGAGACTTGGACAAGCCCCGTCGCTCTCCCACACTGCGCTACAGGAGGAGTAGG

AGCCGGTCTCCCAGAACGCGGAGTCGATCTCCCAAAAGGAGAAGCCCCTCCCCTCGCCGAGAAAGGCATCGGAGCAAGAG

TCCAAGACGTCACCGCAGCAGGTCCCGAGATCGGCGGCACAGATCCCGTTCCAAGTCCCCAGGTCATCACCGTAGTCACA

GACACAGGAGCCACTCAAAGTCTCCCGAAAGGTCTAAGAAGAGCCACAAGAAGAGCCGGAGAGGGAATGAGTAATGGACT

CAGTTTGGTTTTAGTCCACATGGCCTCCTGTGGATATAAGGATATCTGTATGTG

A NOV4a polypeptide (SEQ ID NO:32) encoded by SEQ ID NO:31 is 312 amino acid residues and is presented using the one letter code in Table 16B. Signal P, Psort and/or Hydropathy results predict that NOV4a has no signal peptide and is likely to be localized at the nucleus with a certainty of 0.9894. In other embodiments, NOV4a may also be localized to the mitochondrial matrix space with a certainty of 0.1000, or the lysosome (lumen) with a certainty of 0.1000.

TABLE 16B

NOV4a protein sequence (SEQ ID NO:32)
MANRTVKDAHSIHGTNPQYLVEKIIRTRIYESKYWKEECFGLTAELVVDKAMELRFVGGVYGGNIKPTPFLCLTLKMLQI

QPEKDIIVEFIKNEDFKYVRMLGALYMRLTGTAIDCYKYLEPLYNDYRKIKSQNRNGEFELMHVDEFIDELLQSERVCDI

ILPRLQKRYVLEEAEQLEPRVSALEEDMDDVESSEEEEEDEKLERVPSPDHRRRSYRDLDKPRRSPTLRYRRSRSRSPR

RRSRSPKRRSPSPRRERHRSKSPRRHRSRSRDRRHRSRSKSPGHHRSHRHRSHSKSPERSKKSHKKSRRGNE

NOV4a is expressed in at least multiple normal and cancerous tissues.

NOV4b

A disclosed NOV4b nucleic acid of 1089 nucleotides identified as SEQ ID NO:319 (designated CuraGen Acc. No. CG56166-02) encoding a novel Multidrug transporter-like protein is shown in Table 16C.

using the one letter code in Table 16D. Signal P, Psort and/or Hydropathy results predict that NOV4b has no signal peptide and is likely to be localized at the nucleus with a certainty of 0.9891. In other embodiments, NOV4b may also be localized to the mitochondrial matrix space with a

TABLE 16C

NOV4b Nucleotide Sequence

TCTTCCACCTTTCTCCATTCCTCTAGGTGCTTTTTCTGAACCTGGATGTGAGGCATTAAA (SEQ ID NO:319)

GGATCCGACGGAAATAGAATTGAAGGCATTCTAAAATGGCTAACCGTACAGTGAAGGATG

CGCACAGCATCCATGGCACCAACCCTCAATATCTGGTGGAGAAGATCATTCGAACGCGAA

TCTATGAGTCCAAGTACTGGAAAGAGGAGTGCTTTGGACTTACAGCTGAACTTGTAGTCG

ATAAAGCCATGGAGTTAAGGTTTGTGGGTGGCGTCTATGGTGGCAACATAAAACCAACAC

CCTTTCTGTGTTTAACCTTGAAGATGCTTCAAATTCAACCCGAGAAGGATATCATTGTAG

AGTTTATCAAAAATGAAGATTTCAAGTATGTCCGCATGCTGGGGGCACTTTACATGAGGC

TGACAGGCACTGCAATTGATTGCTACAAGTACTTGGAACCTTTGTACAATGACTATCGAA

AAATCAAGAGCCAGAACCGAAATGGGGAGTTTGAATTGATGCATGTTGATGAGTTTATTG

ATGAACTATTGCACAGTGAGAGAGTCTGTGATATCATTCTGCCCCGACTACAGAAACGCT

ATGTATTAGAGGAAGCTGAGCAACTGGAGCCTCGAGTTAGTGCTCTGGAAGAGGACATGG

ATGATGTGGAGTCCAGTGAAGAGGAAGAAGAGGAGGATGAGAAGTTGGAAAGAGTGCCAT

CACCTGATCACCGCCGGAGAAGCTACCGAGACTTGGACAAGCCCCTTCGCTCTCCCACAC

TGCGCTACAGGAGGAGTAGGAGCCGGTCTCCCAGAAGGCGGAGTCGATCTCCCAAAAGGA

GAAGCCCCTCCCCTCGCCGAGAAAGGCATCGGAGCAAGAGTCCAAGACGTCACCGCAGCA

GGTCCCGAGATCGGCGGCACAGATCCCGTTCCAAGTCCCCAGGTCATCACCGTAGTCACA

GACACAGGAGCCACTCAAAGTCTCCCGAAAGGTCTAAGAAGAGCCACAAGAAGAGCCGGA

GAGGGAATGAGTAAATGGACTCAGTTTGGTTTTAGTCCACATGGCCTCCTGTGGATATAAG

GATATCTGT

A NOV4b polypeptide (SEQ ID NO:320) encoded by SEQ ID NO:319 is 312 amino acid residues and is presented certainty of 0.1000, or the lysosome (lumen) with a certainty of 0.1000.

TABLE 16D

NOV4b protein sequence

MANRTVKDAHSIHGTNPQYLVEKIIRTRIYESKYWKEECFGLTAELVVDKAMELRFVGGV (SEQ ID NO:320)

YGGNIKPTPFLCLTLKMLQIQPEKDIIVEFIKNEDFKYVRMLGALYMRLTGTAIDCYKYL

EPLYNDYRKIKSQNRNGEFELMHVDEFIDELLHSERVCDIILPRLQKRYVLEEAEQLEPR

VSALEEDMDDVESSEEEEEDEKLERVPSPDHRRRSYRDLDKPLRSPTLRYRRSRSRSPR

RRSRSPKRRSPSPRRERHRSKSPRRHRSRSRDRRHRSRSKSPGHHRSHRHRSHSKSPERS

KKSHKKSRRGNE

NOV4b is expressed in at least Bone, Bone Marrow, Brain, Cartilage, Epidermis, Hippocampus, Kidney, Left cerebellum, Liver, Lung, Lymphoid tissue, Ovary, Oviduct/ Uterine Tube/Fallopian tube, Peripheral Blood, Substantia Nigra, Thalamus, Thymus, Tonsils, Urinary Bladder, and Uterus.

NOV4a has homology to the amino acid sequences shown in the BLASTP data listed in Table 16E.

TABLE 16E

BLAST results for NOV4a

| Gene Index/ Identifier | Protein/Organism | Length (aa) | Identity (%) | Positives (%) | Expect |
|---|---|---|---|---|---|
| gi\|10727696\|gb\|AAF5 8976.2\| (AE003834) | CG8054 gene product [*Drosophila melanogaster*] | 856 | 57 | 70 | 2e−90 |
| gi\|17454329\|ref\|XP_ 061203.1\| (XM_061203) | similar to CG8054 gene product (*H. sapiens*) | 140 | 86 | 88 | 6e−66 |
| gi\|14249602\|ref\|NP_ 116253.1\| (NM_032864) | hypothetical protein FLJ14936 [*Homo sapiens*] | 236 | 99 | 99 | 2e−65 |
| gi\|17559118\|ref\|NP_ 505762.1\| (NM_073361) | D1054.14.p [*Caenorhabditis elegans*] | 320 | 62 | 79 | 3e−62 |
| gi\|15226730\|ref\|NP_ 181597.1\| (NC_003071) | hypothetical protein [*Arabidopsis thaliana*] | 363 | 63 | 7 | 4e−61 |

The homology of these sequences is shown graphically in the ClustalW analysis shown in Table 16F.

TABLE 16F

ClustalW Analysis of NOV4a

```
1) NOV4         (SEQ ID NO:32)
2) gi|10727696| (SEQ ID NO:116)
3) gi|17454329| (SEQ ID NO:117)
4) gi|14249602| (SEQ ID NO:118)
5) gi|17559118| (SEQ ID NO:119)
6) gi|15226730| (SEQ ID NO:120)

10        20        30        40        50
                  ....|....|....|....|....|....|....|....|....|....|
NOV4              MANRTVKDAHSIHGTNPQYLVEKIIRTRIYKSKYWKEECFGLTAELVVDK
gi|10727696|      MANRTVKEAKNVHGTNPQYLLEKIIRSRIYDSKYWKEQCFALTAELLVDK
gi|17454329|      MANRTLKDAHSVRGTNPQYLVGKIIRMRICESKHWKEECFGLMAELVVDN
gi|14249602|      MLQIQPEKDIIVEFIKNGDFKYVRMLGALYMRLTGTAIDCYKYLEPLYND
gi|17559118|      MANRTEKAAKTVKGTNPQFLVEKIIRQRIYDSMYWKERCFALTAELVVDK
gi|15226730|      MANRTDPLAKNIRGTNPQNLVEKIVRTKIYQHTFWKEQCFGLTAETVVDK 60        70        80        90       100
                  ....|....|....|....|....|....|....|....|....|....|
NOV4              AMELRFVGGVYGGNIKPTPFLCITLKMLQIQPEKDIIVEFIKNEDFKYVR
gi|10727696|      AMELRFVGGVYGGNIKPTQFLCITLKMLQIQPEKDIVVEFIKNEEFKYVR
gi|17454329|      AMELMFVGGEYGGNIKPTPFLCIILKMLQIQSEKGITAEFIENEDFKYVH
gi|14249602|      YRKIKSQNRNGEFELMHVDEFIDELLHSERVCDIILPRLQKRYVLEEAEQ
gi|17559118|      GMQLRYIGGIMAGNIKPTPFLCIALKMLQIQPDKDIVLEFIQQEEFKYIR
gi|15226730|      AMELDHLGGTFGGSRKPTPFLCIILKMLQIQPEKEIVVEFIKNDDYKYVR 110       120       130       140       150
                  ....|....|....|....|....|....|....|....|....|....|
NOV4              MLGALYMRLTGTAIDCYKYLEPLYNDYRKIKSQNRNGEFELMHVDEFIDE
gi|10727696|      ALGAFYLRLTGAALDCYKYLEPLYIDNRKLRRQNRACQFEIVYMDEYIDE
gi|17454329|      MLGALYMRLMGTAIDCYKYLEPLYNDYRKIKSQNRNGLN
gi|14249602|      LEPRVSALEEDMDDVESSEEEEEEDEKLERVPSPDHRRRSYRDLFKPRRS
gi|17559118|      ALGAMYMRLTFDSTEIYKYLEPLYNDERKLRYMNKMGRFEAIYMDDFIDN
gi|15226730|      TLGAFYERLTGTDVDVYRYLEPLYNDXRKVRQKLSDGNLFLWFGIEFSLT 160       170       180       190       200
                  ....|....|....|....|....|....|....|....|....|....|
NOV4              LLQSERVCDIILPRLQKRYVLEEAEQLEPRVSALEEDMDDVESSEEEEEE
gi|10727696|      LLRNDRVCDIILPRIQKRSILEENNEIEPKVSVLDEDLDDELPSDEEKAD
gi|17454329|
gi|14249602|      PTLRYRRSRSRSPRRRSRSPKRRSPSPRRERHRSKSPRRHRSRSRDRRHR
gi|17559118|      LLREDRYCDIQLPRLQKRWALEEVDMLPSYKSLLDGDLVAMSDSDSEEEE
gi|15226730|      HVDEVIEELLTKDYSCDIAMPRLKKRWTLEQNGLLEPRKSVLEDDGEEEE
```

TABLE 16F-continued

ClustalW Analysis of NOV4a

```
                  210        220        230        240        250
             ....|....|....|....|....|....|....|....|....|....|
NOV4         DEKLERVPSPDHRRRSYRDLDKPRRSPTLRYRRSRSRSPRRRSRSPKRRS
gi|10727696| ETNRPKENSTAVRRPRRVRSKSRSRSRERERRSGQGNSARSRDYYDELED
gi|17454329|
gi|14249602| SRSKSPGHHRSHRHRSHSKSPERSKKSHKKSRRGNE
gi|17559118| VTKKEKPRLTSRRRSRSRDRERDVGDRREVREREKLKERRERGDDEPGPS
gi|15226730| EKEENEGIADGSEDEMDQRRKSPERERERDRDRRRDSHRHRDRDYDRDYD 260        270        280        290        300
             ....|....|....|....|....|....|....|....|....|....|
NOV4         PSPRRERHRSKSPRRHRSRSRDRRHRSRSKSPGHHRSHRHRSHSKSPERS
gi|10727696| YDRQRNRVRNRDTHNEDYDRRQNNGRHDRERERQDRDSIRERERDGDRDR
gi|17454329|
gi|14249602|
gi|17559118| SSGSGRRDDRDDRRRDRDRSRDRDRRDRRDDDRRDKKKESRRGGADNDEE
gi|15226730| MDRDHDRDYERERGHGRDRDRERDRDHYRERDRDRERGRDRERDRRDRAR 310        320        330        340        350
             ....|....|....|....|....|....|....|....|....|....|
NOV4         KKSHKKSRRGNE
gi|10727696| RDRERERERDRGRHDQRERDSRGEHWCKPDASTSSVLDSEQVGTERNGSM
gi|17454329|
gi|14249602|
gi|17559118| REIAEANALRAKLGLAPLER
gi|15226730| RRSRSRSRDRKRHETDDVRDREEPKKKKEKKEKMKEDGTDHPNPEIAEMN 360        370        380        390        400
             ....|....|....|....|....|....|....|....|....|....|
NOV4
gi|10727696| PRSDTEALVADVETGEDSAPRILDASSAASSEQVDPPPVPPPHDYSSYRW
gi|17454329|
gi|14249602|
gi|17559118|
gi|15226730| RLRASLGMKPLRD 410        420        430        440        450
             ....|....|....|....|....|....|....|....|....|....|
NOV4
gi|10727696| FILEPAVFLIFFARNLIGAVYQNQILYQTCITIEKFNATQCEPLLGIDRG
gi|17454329|
gi|14249602|
gi|17559118|
gi|15226730|

460        470        480        490        500
             ....|....|....|....|....|....|....|....|....|....|
NOV4
gi|10727696| SDADKEVEVIVQTYSANIMMTTSLLESIIPAFASLFLGPWSDKFGRRPIL
gi|17454329|
gi|14249602|
gi|17559118|
gi|15226730|

510        520        530        540        550
             ....|....|....|....|....|....|....|....|....|....|
NOV4
gi|10727696| LTTFTGYLTGALILIVITYITRSTNISPWWFLLSSVPSVVSGGTCALITG
gi|17454329|
gi|14249602|
gi|17559118|
gi|15226730|

560        570        580        590        600
             ....|....|....|....|....|....|....|....|....|....|
NOV4
gi|10727696| IYCYISDVAKERKKALRMVLNEASLCAGIMVGNVASGYIYAATNALVLFS
gi|17454329|
gi|14249602|
gi|17559118|
gi|15226730|

610        620        630        640        650
             ....|....|....|....|....|....|....|....|....|....|
NOV4
gi|10727696| IAGSLMMFALMYVLLFVPESLNPGDIHTGSRVREFFRFDLVTDLIRTCFK
gi|17454329|
gi|14249602|
gi|17559118|
gi|15226730|
```

TABLE 16F-continued

ClustalW Analysis of NOV4a

```
                       660        670        680        690        700
                  ....|....|....|....|....|....|....|....|....|....|
NOV4
gi|10727696|
gi|17454329|      RRPNFDRTIIWLTMIALTIAIFDMEGESTVNYMFVQDKFNWTIKDFSLFN
gi|14249602|
gi|17559118|
gi|15226730|

710        720        730        740        750
                  ....|....|....|....|....|....|....|....|....|....|
NOV4
gi|10727696|
gi|17454329|      ASRIVIQIVGSIVGMLVLRRVLKMSIVTMAMLSLACCVLESTVRATAVYW
gi|14249602|
gi|17559118|
gi|15226730|

760        770        780        790        800
                  ....|....|....|....|....|....|....|....|....|....|
NOV4
gi|10727696|
gi|17454329|      QELYLGMTLGMMRGVMGPMCRAILSHVAPATEVGKIFALTTSMESVSPLG
gi|14249602|
gi|17559118|
gi|15226730|

810        820        830        840        850
                  ....|....|....|....|....|....|....|....|....|....|
NOV4
gi|10727696|
gi|17454329|      AAPLYTTVYKATLENTPGAFNFISAALYFVCYILIAVIFGIQKSMGSSSV
gi|14249602|
gi|17559118|
gi|15226730|

....|.
NOV4
gi|10727696|
gi|17454329|      YQAIGS
gi|14249602|
gi|17559118|
gi|15226730|
```

The development of refractory disease in acute myeloid or lymphoblastic leukaemias (AML, ALL) and multiple myeloma (MM) is frequently associated with the expression of one or several multidrug resistance (MDR) genes. MDR1, MRP1 and LRP have been identified as important adverse prognostic factors in AML, T-ALL and MM. Recently, it has become possible to reverse clinical multidrug resistance by blocking P-glycoprotein-mediated drug efflux. (See Sonneveld, 2000, J. Intern Med, 247:521).

A key issue in the treatment of acute leukemia is the development of resistance to chemotherapeutic drugs. Several mechanisms may account for this phenomenon, including failure of the cell to undergo apoptosis in response to chemotherapy, or failure of the drug to reach and/or affect its intracellular target. This review focuses on the latter mechanism, and on intracellular drug transport resistance mechanisms in particular. Expression of the ATP-binding cassette (ABC) transporter P-glycoprotein (Pgp) has generally been reported to correlate with prognosis in acute myeloid leukemia (AML). Additionally, but more controversial, expression of the ABC transporter multidrug resistance protein (MRP) and the vault-transporter lung resistance protein (LRP) have been correlated with outcome in AML. Despite these findings, functional efflux assays indicate the presence of non-Pgp, non-MRP transporters in AML. Recently, a novel ABC transporter, breast cancer resistance protein (BCRP) was cloned and sequenced in our laboratory. Transfection and overexpression of BCRP in drug-sensitive cells confers drug-resistance to the cells. BCRP is a half-transporter, and may homodimerize or form heterodimers (with a yet unknown half-transporter) to produce an active transport complex. Relatively high expression of BCRP mRNA is observed in approximately 30% of AML cases, suggesting a potential role for this new transporter in drug resistance in leukemia. (See Ross, 2000, Leukemia 14:467).

The disclosed NOV4 nucleic acids of the invention encoding a Multidrug transporter-like protein includes the nucleic acids whose sequence are provided in Table 16A and 16C or a fragment thereof. The invention also includes a mutant or variant nucleic acid any of whose bases may be changed from the corresponding base shown in Table 16A or 16C while still encoding a protein that maintains its Multidrug transporter-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 42 percent of the bases may be so changed.

The disclosed NOV4 proteins of the invention includes the Multidrug transporter-like proteins whose sequences are provided in Table 16B and 16D. The invention also includes a mutant or variant protein any of whose residues may be changed from the corresponding residue shown in Table 16B or 16D while still encoding a protein that maintains its Multidrug transporter-like activities and physiological functions, or a functional fragment thereof. In the mutant or variant protein, up to about 42 percent of the residues may be so changed.

The protein similarity information, expression pattern, and map location for the Multidrug transporter-like proteins and nucleic acids (NOV4) disclosed herein suggest that these NOV4 proteins may have important structural and/or physiological functions characteristic of the Multidrug transporter family. Therefore, the NOV4 nucleic acids and proteins of the invention are useful in potential diagnostic and therapeutic applications. These include serving as a specific or selective nucleic acid or protein diagnostic and/or prognostic marker, wherein the presence or amount of the nucleic acid or the protein are to be assessed, as well as potential therapeutic applications such as the following: (i) a protein therapeutic, (ii) a small molecule drug target, (iii) an antibody target (therapeutic, diagnostic, drug targeting/ cytotoxic antibody), (iv) a nucleic acid useful in gene therapy (gene delivery/gene ablation), and (v) a composition promoting tissue regeneration in vitro and in vivo.

The NOV4 nucleic acids and proteins of the invention are useful in potential diagnostic and therapeutic applications implicated in various diseases and disorders described below. For example, the compositions of the present invention will have efficacy for treatment of patients suffering from diabetes, fetal growth retardation, cancer, glycogen storage disease, hypertension and/or other disorders and conditions. The NOV4 nucleic acids, or fragments thereof, may further be useful in diagnostic applications, wherein the presence or amount of the nucleic acid or the protein are to be assessed.

NOV4 nucleic acids and polypeptides are further useful in the generation of antibodies that bind immunospecifically to the novel substances of the invention for use in therapeutic or diagnostic methods. These antibodies may be generated according to methods known in the art, using prediction from hydrophobicity charts, as described in the "Anti-NOVX Antibodies" section below. These novel proteins can be used in assay systems for functional analysis of various human disorders, which will help in understanding of pathology of the disease and development of new drug targets for various disorders.

NOV5

A disclosed NOV5 nucleic acid of 3168 nucleotides identified as SEQ ID NO:33 (also referred to as CG56151-01) encoding a novel glucose transporter type 2-like protein is shown in Table 17A.

TABLE 17A

NOV5 Nucleotide Sequence (SEQ ID NO:33)
CACAAGACCTGGAATTGACAGGACTCCCAACTAGTACAATGACAGAAGATAAGGTCACTGGGACCCTGGTTTTCACTGTC

ATCACTGCTGTGCTGGGTTCCTTCCAGTTTGGATATGACATTGGTGTGATCAATGCACCTCAACAGGTAATAATATCTCA

CTATAGACATGTTTTGGGTGTTCCACTGGATGACCGAAAAGCTATCAACAACTATGTTATCAACAGTACAGATGAACTGC

CCACAATCTCATACTCAATCAACCCAAAACCAACCCCTTGGGCTGAGGAAGAGACTGTGGCAGCTGCTCAACTAATCACC

ATGCTCTGGTCCCTGTCTGTATCCAGCTTTGCAGTTGGTGGAATGACTGCATCATTCTTTGGTGGGTGGCTTGGGGACAC

ACTTGGAAGAATCAAAGCCATGTTAGTAGCAAACATTCTGTCATTAGTTGGAGCTCTCTTGATGGGGTTTTCAAAATTGG

GACCATCTCATATACTTATAATTGCTGGAAGAAGCATATCAGGACTATATTGTGGGCTAATTTCAGGCCTGGTTCCTATG

TATATCGGTGAAATTGCTCCAACCGCTCTCAGGGGAGCACTTGGCACTTTTCATCAGCTGGCCATCGTCACGGGCATTCT

TATTAGTCAGATTATTGGTCTTGAATTTATCTTGGGCAATTATGATCTGTGGCACATCCTGCTTGGCCTGTCTGGTGTGC

GAGCCATCCTTCAGTCTCTGCTACTCTTTTTCTGTCCAGAAAGCCCCAGATACCTTTACATCAAGTTAGATGAGGAAGTC

AAAGCAAAACAAAGCTTGAAAAGACTCAGAGGATATGATGATGTCACCAAAGATATTAATGAAATGAGAAAAGAAAGAGA

AGAAGCATCGAGTGAGCAGAAAGTCTCTATAATTCAGCTCTTCACCAATTCCAGCTACCGACAGCCTATTCTAGTGGCAC

TGATGCTGCATGTGGCTCAGCAATTTTCCGGAATCAATGGCATTTTTTACTACTCAACCAGCATTTTTCAGACGGCTGGT

ATCAGCAAACCTGTTTATGCAACCATTGGAGTTGGCGCTGTAAACATGGTTTTCACTGCTGTCTCTGTATTCCTTGTGGA

GAAGGCAGGGCGACGTTCTCTCTTTCTAATTGGAATGAGTGGGATGTTTGTTTGTGCCATCTTCATGTCAGTGGGACTTG

TGCTGCTGAATAAGPTCTCTTGGATGAGTTATGTGAGCATGATAGCCATCTTCCTCTTTGTCAGCTTCTTTGAAATTGGG

CCAGGCCCGATCCCCTGGTTCATGGTGGCTGAGTTTTTCAGTCAAGGACCACGTCCTGCTGCTTTAGCAATAGCTGCATT

CAGCAATTGGACCTGCAATTTCATTGTAGCTCTGTGTTTCCAGTACATTGCGGACTTCTGTGGACCTTATGTGTTTTTCC

TCTTTGCTGGAGTGCTCCTGGCCTTTACCCTGTTCACATTTTTTAAAGTTCCAGAAACCAAAGGAAAGTCTTTTGAGGAA

ATTGCTGCAGAATTCCAAAAGAAGAGTGGCTCAGCCCACAGGCCAAAAGCTGCTGTAGAAATGAAATTCCTAGGAGCTAC

TABLE 17A-continued

NOV5 Nucleotide Sequence

```
AGAGACTGTGTAAAAAAAAAACCCTGCTTTTTGACATGAACAGAAACAATAAGGGAACCGTCTGTTTTTAAATGATGATT
CCTTGAGCATTTTATATCCACATCTTTAAGTATTGTTTTATTTTTATGTGCTCTCATCAGAAATGTCATCAAATATTACC
AAAAAAGTATTTTTTTAAGTTAGAGAATATATTTTTGATGGTAAGACTGTAATTAAGTAAACCAAAAAGGCTAGTTTATT
TTGTTACACTAAAGGGCAGGTGGTTCTAATATTTTTAGCTCTGTTCTTTATAACAAGGTTCTTCTAAAATTGAAGAGATT
TCAACATATCATTTTTTTAACACATAACTAGAAACCTGAGGATGCAACAAATATTTATATATTTGAATATCATTAAATTG
GAATTTTCTTACCCATATATCTTATGTTAAAGGAGATATGGCTAGTGGCAATAAGTTCCATGTTAAAATAGACAACTCTT
CCATTTATTGCACTCAGCTTTTTTCTTGAGTACTAGAATTTGTATTTTGCTTAAAATTTTACTTTTGTTCTGTATTTTCA
TGTGGAATGGATTATAGAGTATACTAAAAAAATGTCTATAGAGAAAAACTTTCATTTTTGGTAGGCTTATCAAAATCTTTC
AGCACTCAGAAAAGAAAACCATTTTAGTTCCTTTATTTAATGGCCAAATGGTTTTTGCAAGATTTAACACTAAAAAGGTT
TCACCTGATCATATAGCGTGGGTTATCAGTTAACATTAACATCTATTATAAAACCATGTTGATTCCCTTCTGGTACAATC
CTTTGAGTTATAGTTTGCTTTGCTTTTTAATTGAGGACAGCCTGGTTTTCACATACACTCAAACAATCATGAGTCAGACA
TTTGGTATATTACCTCAAATTCCTAATAAGTTTGATCAAATCTAATGTAAGAAAATTTGAAGTAAAGGATTGATCACTTT
GTTAAAAATATTTTCTGAATTATTATGTCTCAAAATAAGTTGAAAAGGTAGGGTTTGAGGATTCCTGAGTGTGGGCTTCT
GAAACTTCATAAATGTTCAGCTTCAGACTTTTATCAAAATCCCTATTTAATTTTCCTGGAAAGACTGATTGTTTTATGGT
GTGTTCCTAACATAAAATAATCGTCTCCTTTGACATTTCCTTCTTTGTCTTAGCTGTATACAGATTCTAGCCAAACTATT
CTATGGCCATTACTAACACGCATTGTACACTATCTATCTGCCTTTACCTACATAGGCAAATTGGAAATACACAGATGATT
AAACAGACTTTAGCTTACAGTCAATTTTACAATTATGGAAATATAGTTCTGATGGGTCCCAAAAGCTTAGCAGGGTGCTA
ACGTATCTCTAGGCTGTTTTCTCCACCAACTGGAGCACTGATCAATCCTTCTTATGTTTGCTTTAATGTGTATTGAAGAA
AAGCACTTTTTAAAAAGTACTCTTTAAGAGTGAAATAATTAAAAACCACTGAACATTTGCTTTGTTTTCTAAAGTTGTTC
ACATATATGTAATTTAGCAGTCCAAAGAACAAGAAATTGTTTCTTTTC
```

The NOV5 nucleic acid was identified on chromosome 3.

A disclosed NOV5 polypeptide (SEQ ID NO:34) encoded by SEQ ID NO:33 is 524 amino acid residues and is presented using the one-letter code in Table 17B. Signal P, Psort and/or Hydropathy results predict that NOV5 has a signal peptide and is likely to be localized in the plasma membrane with a certainty of 06400. In other embodiments, NOV5 may also be localized to the golgi body with a certainty of 0.4600, the endoplasmic reticulum (membrane) with a certainty of 0.3700, or the endoplasmic reticulum (lumen) with a certainty of 0.1000. The most likely cleavage site is between positions 20 and 21:VGL-SF.

TABLE 17B

Encoded NOV5 protein sequence (SEQ ID NO:34)
```
MTEDKVTGTLVFTVITAVLGSFQFGYDTGVINAPQQVIISHYRHVLGVPLDDRKAINNYVINSTDELPTISYSMNPKPTP
WAEEETVAAAQLITMLWSLSVSSFAVGGMTASFFGGWLGDTLGRIKAMLVANILSLVGALLMCFSKLGPSHILIIAGRSI
SGLYCGLISGLVPMYTGEIAPTALRGALGTFHQLAIVTGILISQIIGLEFILGNYDLWHILLGLSGVRAILQSLLLFFCP
ESPRYLYIKLDEEVKAKQSLKRLRGYDDVTKDINEMRKEREEASSEQKVSIIQLFTNSSYRQPILVALMLHVAQQFSGIN
GIFYYSTSIFQTAGISKPVYATIGVGAVNNVFTAVSVFLVEKAGRRSLFLIGMSGMFVCAIFMSVGLVLLNKFSWMSYVS
MIAIFLFVSFFEIGPGPIPWFMVAEFFSQGPRPAALAIAAFSMWTCNFIVALCPQYIADFCGPYVFFLFAGVLLAFTLFT
FFKVPETKGKSFEEIAAEFQKKSGSAHRPKAAVEMKFLGATETV
```

NOV5 is expressed in at least the liver. This information was derived by determining the tissue sources of the sequences that were included in the invention including but not limited to SeqCalling sources, Public EST sources, Literature sources, and/or RACE sources.

NOV5 has homology to the amino acid sequences shown in the BLASTP data listed in Table 17C.

TABLE 17C

BLAST results for NOV5

| Gene Index/ Identifier | Protein/Organism | Length (aa) | Identity (%) | Positives (%) | Expect |
|---|---|---|---|---|---|
| gi|4557851|ref|NP_000331.1| (NM_000340) | solute carrier family 2 (facilitated glucose transporter), member 2 [Homo sapiens] | 524 | 100 | 100 | 0.0 |
| gi|12836740|dbj| BAB23792.1| | (AK005068) putative [Mus musculus] | 523 | 81 | 89 | 0.0 |
| gi|90517|pir||S05319 | glucose transport protein, hepatic - mouse | 523 | 81 | 89 | 0.0 |
| gi|2143756|pir|| S68362 | glucose transport protein type 2 - rat | 522 | 81 | 89 | 0.0 |
| gi|92281|pir||A3|556 | glucose transport protein, hepatic - rat | 522 | 81 | 89 | 0.0 |

The homology of these sequences is shown graphically in the ClustalW analysis shown in Table 17D.

TABLE 17D

Clustal W Sequence Alignment

```
1) NOV5          (SEQ ID NO:34)
2) gi|4557851|   (SEQ ID NO:121)
3) gi|17380402|  (SEQ ID NO:122)
4) gi|13654262|  (SEQ ID NO:123)
5) gi|2143756|   (SEQ ID NO:124)
6) gi|6981548|   (SEQ ID NO:125)

10        20        30        40        50
                 ....|....|....|....|....|....|....|....|....|....|
NOV5             MSEDKVTGTLVFTVITAVLGSFQFGYDIGVINAPQQVIISHYRHVLGVPL
gi|4557851|      MSEDKVTGTLVFTVITAVLGSFQFGYDIGVINAPQQVIISHYRHVLGVPL
gi|17380402|     MSEDKITGTLVFTVFTAVLSSFQFGYDIGVINAPQEVIISHYRHVLGVPL
gi|13654262|     MSEDKITGTLVFTVFTAVLSSFQFGYDIGVINAPQEVIISHYRHVLGVPL
gi|2143756|      MSEDKITGTLVFTVFTAVLGSFQFGYDIGVINAPQEVIISHYRHVLGVPL
gi|6981548|      MSEDKITGTLVFTVFTAVLGSFQFGYDIGVINAPQEVIISHYRHVLGVPL 60        70        80        90       100
                 ....|....|....|....|....|....|....|....|....|....|
NOV5             DDRKAINNYVINSTDELPTISYSMNPKPTPWAEEETVAAAQEITMLWSLS
gi|4557851|      DDRKAINNYVINSTDELPTISYSMNPKPTPWAEEETVAAAQEITMLWSLS
gi|17380402|     DDRKAINYDVNGTDTPLTVTPAMI-TPAPWDEEETEGSAHIVTMLWSLS
gi|13654262|     DDRKAINYDVNGTDTPLTVTPAMI-TPAPWDEEETEGSAHIVTMLWSLS
gi|2143756|      DDRKATINYDINGTDTPLIVTPAMI-TPDAW-EEETEGSAHIVTMLWSLS
gi|6981548|      DDRKATINYDINGTDTPLIVTPAMI-TPDAW-EEETEGSAHIVTMLWSLS 110       120       130       140       150
                 ....|....|....|....|....|....|....|....|....|....|
NOV5             VSSFAVGGMTASFFGGWLGDTLGRIKAMIVANILSIVGALLMGFSKLGES
gi|4557851|      VSSFAVGGMTASFFGGWLGDTLGRIKAMIVANILSIVGALLMGFSKLGES
gi|17380402|     VSSFAVGGMVASFFGGWLGDKLGRIKAMLAANSLSLTGALLMGCSKFGPA
gi|13654262|     VSSFAVDGMVASFFGGWLGDKLGRIKAMLAANSLSLTGALLMGCSKFGPA
gi|2143756|      VSSFAVGGMVASFFGGWLGDKLGRIKAMLAANSLSLTGALLMGCSKFGPA
gi|6981548|      VSSFAVGGMVASFFGGWLGDKLGRIKAMLAANSLSLTGALLMGCSKFGPA
```

TABLE 17D-continued

Clustal W Sequence Alignment

```
                160        170        180        190        200
                ....|....|....|....|....|....|....|....|....|....|
NOV5          HILIIAGRSISGLYCGLISGLVPMYIGEIAPTALRGALGTFHQLAIVTGI
gi|4557851|   HILIIAGRSISGLYCGLISGLVPMYIGEIAPTALRGALGTFHQLAIVTGI
gi|17380402|  HALIIAGRSVSGLYCGLISGLVPMYIGEIAPTTLRGALGTLHQLALVTGI
gi|13654262|  HALIIAGRSVSGLYCGLISGLVPMYIGEIAPTTLRGALGTLHQLALVTGI
gi|2143756|   HALIIAGRSVSGLYCGLISGLVPMYIGEIAPTTLRGALGTLHQLALVTGI
gi|6981548|   HALIIAGRSVSGLYCGLISGLVPMYIGEIAPTTLRGALGTLHQLALVTGI 210        220        230        240        250
                ....|....|....|....|....|....|....|....|....|....|
NOV5          LISQIIGLEFILGNYDLWHILLGLSGVRAILQSLLLFFCPESPRYLYIKL
gi|4557851|   LISQIIGLEFILGNYDLWHILLGLSGVRAILQSLLLFFCPESPRYLYIKL
gi|17380402|  LISQIAGLSFILGNQDHWHILLGLSAVPALLQCLLLLFCPESPRYLYIKL
gi|13654262|  LISQIAGLSFILGNQDHWHILLGLSAVPALLQCLLLLFCPESPRYLYIKL
gi|2143756|   LISQIAGLSFILGNQDYWHILLGLSAVPALLQCLLLLFCPESPRYLYLKL
gi|6981548|   LISQIAGLSFILGNQDYWHILLGLSAVPALLQCLLLLFCPESPRYLYLNL 260        270        280        290        300
                ....|....|....|....|....|....|....|....|....|....|
NOV5          DEEVKAKQSLKRLRGYEDVTKDINEMRKEREEASSEQKVSIIQLFTNSSY
gi|4557851|   DEEVKAKQSLKRLRGYEDVTKDINEMRKEREEASSEQKVSIIQLFTNSSY
gi|17380402|  EEEVRAKKSLKRLRGTEDVTKDINEMRKEKEEASTEQKVSVIQLFTDANY
gi|13654262|  EEEVRAKKSLKRLRGTEDVTKDINEMKKEKEEASTEQKVSVIQLFTDANY
gi|2143756|   EEEVRAKKSLKRLRGTEDITKDINEMRKEKEEASTEQKVSVIQLFTDPNY
gi|6981548|   EEEVRAKKSLKRLRGTEDITKDINEMRKEKEEASTEQKVSVIQLFTDPNY 310        320        330        340        350
                ....|....|....|....|....|....|....|....|....|....|
NOV5          RQPILVALMLHVAQQFSGINGIFYYSTSIFQTAGISKPVYATIGVGAVNM
gi|4557851|   RQPILVALMLHVAQQFSGINGIFYYSTSIFQTAGISKPVYATIGVGAVNM
gi|17380402|  RQPILVALMLHMAQQFSGINGIFYYSTSIFQTAGISQPVYATIGVGAINM
gi|13654262|  RQPILVALMLHMAQQFSGINGIFYYSTTIFQTAGISQPVYATIGVGAINM
gi|2143756|   RQPIVVALMLHLAQQFSGINGIFYYSTSIFQTAGISQPVYATIGVGAINM
gi|6981548|   RQPIVVALMLHIAQQFSGINGIFYYSTSIFQTAGISQPVYATIGVGAINM 360        370        380        390        400
                ....|....|....|....|....|....|....|....|....|....|
NOV5          VFTAVSVFLVEKAGRRSLFLIGMSGMFVCAIFMSVGLVLINKFSWMSYVS
gi|4557851|   VFTAVSVFLVEKAGRRSLFLIGMSGMFVCAIFMSVGLVLINKFSWMSYVS
gi|17380402|  IFTAVSVLLVEKAGRRTLFLTGMIGMFFCTIFMSVGLVLLDKFAWMSYVS
gi|13654262|  IFTAVSVLLVEKAGRRTLFLTGMIGMFFCTIFMSVGLVLLDKFAWMSYVS
gi|2143756|   IFTAVSVLLVEKAGRRTLFLAGMIGMFFCAVFMSLGLVLLDKFTWMSYVS
gi|6981548|   IFTAVSVLLVEKAGRRTLFLAGMIGMFFCAVFMSLGLVLLDKFRWMSYVS 410        420        430        440        450
                ....|....|....|....|....|....|....|....|....|....|
NOV5          MIAIFLFVSFFEIGPGPIPWPMVAEFFSQGPRPAALATAAFSNWTCNFIV
gi|4557851|   MIAIFLFVSFFEIGPGPIPWPMVAEFFSQGPRPAALATAAFSNWTCNFIV
gi|17380402|  MTAIFLFVSFFEIGPGPIPWPMVAEFFSQGPRPTALALAAFSNWVCNFVI
gi|13654262|  MTAIFLFVSFFEIGPGPIPWPMVAEFFSQGPRPTALALAAFSNWVCNFVI
gi|2143756|   MTAIFLFVSFFEIGPGPIPWPMVAEFFSQGPRPTALALAAFSNWVCNFII
gi|6981548|   MTAIFLFVSFFEIGPGPIPWPMVAEFFSQGPRPTALALAAFSNWVCNFII 460        470        480        490        500
                ....|....|....|....|....|....|....|....|....|....|
NOV5          ALCFQYIADFCGPYVFFLFAGVLLAFTLFTFFKVPETKGKSFEEIAAEFQ
gi|4557851|   ALCFQYIADFCGPYVFFLFAGVLLAFTLFTFFKVPETKGKSFEEIAAEFQ
gi|17380402|  ALCFQYIADFLGPYVFFLFAGVVLVFTLFTFFKVPETKGKSFEEIAAEFR
gi|13654262|  ALCFQYIADFLGPYVFFLFAGVVLVFTLFTFFKVPETKGKSFEEIAAEFR
gi|2143756|   ALCFQYIADFLGPYVFFLFAGVVLVFTLFTFFKVPETKGKSFDEIAAEFR
gi|6981548|   ALCFQYIADFLGPYVFFLFAGVVLVFTLFTFFKVPETKGKSFDEIAAEFR 510        520
                ....|....|....|....|....
NOV5          KKSGSAHRPKAAVEMKFLGATETV
gi|4557851|   KKSGSAHRPKAAVEMKFLGATETV
gi|17380402|  KKSGSAPPRKAAVQMEFLASSESV
gi|13654262|  KKSGSAPPRKAAVQMEFLASSESV
gi|2143756|   KKSGSAPPRKATVQMEFLGSSETV
gi|6981548|   KKSGSAPPRKATVQMEFLGSSETV
```

Table 17E lists the domain description from DOMAIN analysis results against NOV5. This indicates that the NOV4 sequence has properties similar to those of other proteins known to contain this domain.

TABLE 17E

Domain Analysis of NOV5 gnl|Pfam|pfam00083, sugar_tr, Sugar (and other) transporter.
CD-Length = 447 residues, 99.6%
aligned Score = 344 bits (882), Expect = 8e-96

There are two mechanisms for glucose transport across cell membranes. In the intestine and renal proximal tubule, glucose is transported against a concentration gradient by a secondary active transport mechanism in which glucose is cotransported with sodium ions. In all other cells, glucose transport is mediated by one or more of the members of the closely related GLUT family of glucose transporters. The pattern of expression of the GLUT transporters in different tissues is related to the different roles of glucose metabolism in different tissues. Primary defects in glucose transport all appear to be extremely rare and not all possible deficiencies have been identified. Deficiency of the secondary active sodium/glucose transporters result in glucose/galactose malabsorption or congenital renal glycosuria. GLUT1 deficiency produces a seizure disorder with low glucose concentration in cerebrospinal fluid and GLUT2 deficiency is the basis of the Fanconi-Bickel syndrome, which resembles type I glycogen storage disease. (See Brown, 2000, J Inherit Metab Dis 23(3):237).

The disclosed NOV5 nucleic acid of the invention encoding a glucose transporter type 2-like protein includes the nucleic acid whose sequence is provided in Table 17A or a fragment thereof. The invention also includes a mutant or variant nucleic acid any of whose bases may be changed from the corresponding base shown in Table 17A while still encoding a protein that maintains its glucose transporter type 2-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 0 percent of the bases may be so changed.

The disclosed NOV5 protein of the invention includes the glucose transporter type 2-like protein whose sequence is provided in Table 17B. The invention also includes a mutant or variant protein any of whose residues may be changed from the corresponding residue shown in Table 17B while still encoding a protein that maintains its glucose transporter type 2-like activities and physiological functions, or a functional fragment thereof. In the mutant or variant protein, up to about 0 percent of the residues may be so changed.

The NOV5 nucleic acids and proteins of the invention are useful in potential therapeutic applications implicated in diabetes, fetal growth retardation, cancer, glycogen storage disease, hypertension and/or other disorders and conditions. The NOV5 nucleic acid, or fragments thereof, may further be useful in diagnostic applications, wherein the presence or amount of the nucleic acid or the protein are to be assessed.

NOV5 nucleic acids and polypeptides are further useful in the generation of antibodies that bind immunospecifically to the novel substances of the invention for use in therapeutic or diagnostic methods. These antibodies may be generated according to methods known in the art, using prediction from hydrophobicity charts, as described in the "Anti-NOVX Antibodies" section below. For example the disclosed NOV5 protein have multiple hydrophilic regions, each of which can be used as an immunogen. This novel protein also has value in development of powerful assay system for functional analysis of various human disorders, which will help in understanding of pathology of the disease and development of new drug targets for various disorders.

NOV6

A disclosed NOV6 nucleic acid of 2184 nucleotides identified as SEQ ID NO:35 (also referred to as CG CG55690-01) encoding a novel Frizzled-9-like protein is shown in Table 18A.

TABLE 18A

NOV6 Nucleotide Sequence (SEQ ID NO:35)
CCGCCTTCGGCCCGGGCCTCCCGGGATGGCCGTGGCGCCTCTGCGGGGGCGCTGCTGCTGTGGCAGCTGCTGGCGGCGG

GCGGCGCGGCACTGGAGATCGGCCGCTTCGACCCGGAGCGCGGGCGCGGGGCTGCGCCGTGCCAGGCGGTGGAGATCCCC

ATGTGCCGCGGCATCGGCTACAACCTGACCCGCATGCCCAACCTGCTGGGCCACACGTCGCAGGGCGAGGCGGCTGCCGA

GCTAGCGGAGTTCGCGCCGCTGGTGCAGTACGGCTGCCACAGCCACCTGCGCTTCTTCCTGTGCTCGCTCTACGCGCCCA

TGTGCACCGACCAGGTCTCGACGCCCATTCCCGCCTGCCGGCCCATGTGCGAGCAGGCGCGCCTGCGCTGCGCGCCCATC

ATGGAGCAGTTCAACTTCGGCTGGCCGGACTCGCTCGACTGCGCCCGGCTGCCCACGCGCAACGACCCGCACGCGCTGTG

CATGGAGGCGCCCGAGAACGCCACGGCCGGCCCCGCGGAGCCCCACAAGGGCCTGGGCATGCTGCCCGTGGCGCCGCGGC

TABLE 18A-continued

NOV6 Nucleotide Sequence

```
CCGCGCGCCCTCCCGGAGACCTGGGCCCGGGCGCGGGCGGCAGTGGCACCTGCGAGAACCCCGAGAAGTTCCAGTACGTG
GAGAAGAGCCGCTCGTGCGCACCGCGCTGCGGGCCCGGCGTCGAGGTGTTCTGGTCCCGGCGCGACAAGGACTTCGCGCT
GGTCTGGATGGCCGTGTGGTCGGCGCTGTGCTTCTTCTCCACCGCCTTCACTGTGCTCACCTTCTTGCTGGAGCCCCACC
GCTTCCAGTACCCCGAGCGCCCCATCATCTTCCTCTCCATGTGCTACAACGTCTACTCGCTGGCCTTCCTGATCCGTGCG
GTGGCCGGAGCGCAGAGCGTGGCCTGTGACCAGGAGGCGGGCGCGCTCTACGTGATCCAGGAGGGCCTGGAGAACACGGG
CTGCACGCTGGTCTTCCTACTGCTCTACTACTTCGGCATGGCCAGCTCGCTCTGGTGGGTGGTCCTGACGCTCACCTGGT
TCCTGGCTGCCGGGAAGAAATGGGGCCACGAGGCCATCGAGGCCCACGGCAGCTATTTCCACATGGCTGCCTGGGGCCTG
CCCGCGCTCAAGACCATCGTCATCCTGACCCTGCGCAAGGTGGCGGGTGATGAGCTGACTGGGCTTTGCTACGTGGCCAG
CACGGATGCAGCAGCGCTCACGGGCTTCGTGCTGGTGCCCCTCTCTGGCTACCTGGTGCTGGGCAGTAGTTTCCTCCTGA
CCGGCTTCGTGGCCCTCTTCCACATCCGCAAGATCATGAAGACGGGCGGCACCAACACAGAGAAGCTGGAGAAGCTCATG
GTCAAGATCGGGGTCTTCTCCATCCTCTACACGGTGCCCGCCACCTGCGTCATCGTTTGCTATGTCTACGAACGCCTCAA
CATGGACTTCTGGCGCCTTCGGGCCACAGAGCAGCCATGCGCAGCGGCCGCGGGCCCGGAGGCCGGAGGGACTGCTCGC
TGCCAGGGGCTCGGTGCCCACCGTGGCGGTCTTCATGCTCAAAATTTTCATGTCACTGGTGGTGGGGATCACCAGCGGC
GTCTGGGTGTGGAGCTCCAAGACTTTCCAGACCTGGCAGAGCCTGTGCTACCGCAAGATAGCAGCTGGCCGGGCCCGGGC
CAAGGCCTGCCGCGCCCCGGGAGCTACGACGTGGCACGCACTGCCACTATAAGGCTCCCACCGTGGTCTTGCACATGA
CTAAGACGGACCCCTCTTTGGAGAACCCCACACACCTCTAGCCACACAGGCCTGGCGCGGGTGGCTGCTGCCCCTCCT
TGCCCTCCACGCCCTGCCCCCTGCATCCCCTAGAGACAGCTGACTAGCAGCTGCCCAGCTGTCAAGGTCAGGCAAGTGAG
CACCGGGGACTGAGGATCAGGGCGGGACCCCGTGAGGCTCATTAGGGGAGATGGGGGTCTCCCCTAATGCGGGGCTGGA
CCAGGCTGAGTCCCCACAGGGTCCTAGTGGAGGATGTGGAGGGGCGGGCAGAGGGGTCCAGCCGGAGTTTATTTAATGA
TGTAATTTATTGTTGCGTTCCTCTGGAAGCTGTGACTGGAATAAACCCCCGCGTGGCACTGCTGATCCTCTCTGGCTGGG
AAGGGGGAAGGTAGGAGGTGAGGC
```

The disclosed NOV6 nucleic acid sequence is located on chromosome 7q11.23.

A disclosed NOV6 polypeptide (SEQ ID NO:36) encoded by SEQ ID NO:35 is 591 amino acid residues and is presented using the one-letter amino acid code in Table 18B. Signal P, Psort and/or Hydropathy results predict that NOV6 contains a signal peptide and is likely to be localized at the plasma membrane with a certainty of 0.6400. In other embodiments, NOV6 is also likely to be localized to the golgi body with a certainty of 0.4600, to the endoplasmic reticulum (membrane) with a certainty of 0.3700, or to the endoplasmic reticulum (lumen) with a certainty of 0.1000. The most likely cleavage site is between positions 22 and 23:GAA-LE.

TABLE 18B

Encoded NOV6 protein sequence.

(SEQ ID NO:36)

```
MAVAPLRGALLLWQLLAAGGAALEIGRFDPERGRGAAPCQAVEIPMCRGIGYNLTRMPNLLGHTSQGEAAAELAEFAPLV
QYGCHSHLRFFLCSLYAPMCTDQVSTPIPACRPMCEQARLRCAPIMEQFNFGWPDSLDCARLPTRNDPHALCMEAPENAT
AGPAEPHKGLGMLPVAPRPARPPGDLGPGAGGSGTCENPEKFQYVEKSRSCAPRCGPGVEVFWSRRDKDFALVWMAVWSA
LCFFSTAFTVLTFLLEPHRFQYPERPIIFLSMCYNVYSLAFLIRAVAGAQSVACDQEAGALYVIQEGLENTGCTLVFLLL
YYFGMASSLWWVVLTLTWFLAAGKKWGHEAIEAHGSYFHMAAWGLPALKTIVILTLRKVAGDELTGLCYVASTDAAALTG
FVLVPLSGYLVLGSSFLLTGFVALFHIRKIMKTGGTNTEKLEKLMVKIGVFSILYTVPATCVIVCYVYERLNMDFWRLRA
TEQPCAAAAGPGGRRDCSLPGGSVPTVAVFMLKIFMSLVVGITSGVWVWSSKTFQTWQSLCYRKIAAGRARAKACRAPGS
YGRGTHCHYKAPTVVLHMTKTDPSLENPTHL
```

NOV6 is expressed in at least the following tissues: brain, lung and carcinoma tissue. This information was derived by determining the tissue sources of the sequences that were included in the invention including but not limited to SeqCalling sources, Public EST sources, Literature sources, and/or RACE sources.

NOV6 has homology to the amino acid sequences shown in the BLASTP data listed in Table 18C.

TABLE 18C

BLAST results for NOV6

| Gene Index/ Identifier | Protein/Organism | Length (aa) | Identity (%) | Positives (%) | Expect |
|---|---|---|---|---|---|
| gi\|12861958\|dbj\|BAB 32311.1\| | (AK021164) putative [Mus musculus] | 592 | 95 | 95 | 0.0 |
| gi\|4689161\|gb\| AAD27789.1\| AF088850.1 (AF088850) | frizzled-9 [Mus musculus] | 592 | 95 | 96 | 0.0 |
| gi\|11419362\|ref\|XP_ 004646.1\| (XM_004646) | frizzled 9 [Homo sapiens] | 591 | 100 | 100 | 0.0 |
| gi\|5042380\|gb\| AAB87503.2 (AF033585) | frizzled-9 protein [Mus musculus] | 549 | 95 | 96 | 0.0 |
| gi\|9622217\|gb\| AAF89677.1\| AF169639.1 (AF169639) | Frizzled X [Daniorerio] | 577 | 72 | 81 | 0.0 |

The homology of these sequences is shown graphically in the ClustalW analysis shown in Table 18D.

TABLE 18D

Information for the ClustalW proteins

```
1) NOV6          (SEQ ID NO:36)
2) gi|12861958|  (SEQ ID NO:126)
3) gi|17433078|  (SEQ ID NO:127)
4) gi|4503835|   (SEQ ID NO:128)
5) gi|5042380|   (SEQ ID NO:129)
6) gi|9622217|   (SEQ ID NO:130)
```

```
                    10        20        30        40        50
             ....|....|....|....|....|....|....|....|....|....|
NOV6         MAVAP-LRGALLLWQLLAAGGAALEIGRFDPERGRAAPCQAVEIPMCRC
gi|12861958  MAVPPLLRGALLLWQLLATGGAALEIGRFDPERGRGPAPCQANEIPMCRC
gi|17433078  MAVPPLLRGALLLWQLLATGGAALEIGRFDPERGRGPAPCQANEIPMCRC
gi|4503835   MAVAP-LRGALLLWQLLAAGGAALEIGRFDPERGRAAPCQAVEIPMCRC
gi|5042380   ------------------------------------------EIPMCRC
gi|9622217   MGSSE--QIVISLWCHEVIAATSLEIGSYDLERGR-PAKCEPIVIPMCQC 60        70        80        90       100
             ....|....|....|....|....|....|....|....|....|....|
NOV6         IGYNLTRMPNLLGHTSQGEAAAKLAEEAPLVQYGCHSHLRFFLCSLYAPM
gi|12861958  IGYNLTRMPNLLGHTSQGEAAAHCAEFSPLVQYGCHSHLRFFFCSLYAPM
gi|17433078  IGYNLTRMPNLLGHTSQGEAAAQLAEFSPLVQYGCHSHLRFFLCSLYAPM
gi|4503835   IGYNLTRMPNLLGHTSQGEAAAKLAEEAPLVQYGCHSHLRFFLCSLYAPM
gi|5042380   IGYNLTRMPNLLGHTPQGEAAAQLAEFSPLVQYGCHSHLRFFLCSLYAPM
gi|9622217   IGYNLTRMPNFMDHDNQREAAIKLNEEAPLVEYGCDVHLRFFLCSLYAPM 110       120       130       140       150
             ....|....|....|....|....|....|....|....|....|....|
NOV6         CTDQVSTPIPACRPMCEQARLRCAPIMEQFNFGWPDSLDCARLPTRNDPH
gi|12861958  CTDQVSTPIPACRPMCEQARLRCAPIMEQFNFGWPDSLDCARLPTRNDPH
gi|17433078  CTDQVSTPIPACRPMCEQARLRCAPIMEQFNFGWPDSLDCARLPTRNDPH
gi|4503835   CTDQVSTPIPACRPMCEQARLRCAPIMEQFNFGWPDSLDCARLPTRNDPH
gi|5042380   CTDQVSTPIPACRPMCEQARLRCAPIMEQFNFGWPDSLDCARLPTRNDPH
gi|9622217   CTDQVSTSIPACRPMCEQARQECSPIMEKFNYAWPESLNCSKLPTRNDPN 160       170       180       190       200
             ....|....|....|....|....|....|....|....|....|....|
NOV6         ALCMEAPENATAGPAEPHKGLGMLPVAPRPARPPGDLGPGAGSGTCSNP
gi|12861958  ALCMEAPENATAGPTEPHKGLGMLPVAPRPARPPGDSAPGPGSGGTCDNP
gi|17433078  ALCMEAPENATAGPTEPHKGLGMLPVAPRPARPPGDSAPGPGSGGTCDNP
gi|4503835   ALCMEAPENATAGPAEPHKGLGMLPVAPRPARPPGDLGPGAGSGTCSNP
gi|5042380   ALCMEAPENATAGPTEPHKGLGMLPVAPRPARPPGDSAPGPGSGGTCDNP
gi|9622217   ALCMEAPENDLK--TETKKGEGMLPVEPRPRQEGAGNARSGGTMGVCENP
```

TABLE 18D-continued

Information for the ClustalW proteins

```
                       210        220        230        240        250
                 ....|....|....|....|....|....|....|....|....|....|
NOV6             EKFQYVEKSRSCAPRCGPGVEVFWSRRDKDFALVWMAVWSALCFFSTAFT
gi|12861958|     EKFQYVEKSRSCAPRCGPGVEVFWSRRDKDFALVWMAVWSALCFFSTAFT
gi|17433078|     EKFQYVEKSRSCAPRCGPGVEVFWSRRDKDFALVWMAVWSALCFFSTAFT
gi|4503835|      EKFQYVEKSRSCAPRCGPGVEVFWSRRDKDFALVWMAVWSALCFFSTAFT
gi|5042380|      EKFQYVEKSRSCAPRCGPGVEVFWSRRDKDFALVWMAVWSALCFFSTAFT
gi|9622217|      EKFQYVEKSETCAPRCSSAVDVFWSRQDKDFAFIWMAVWSTLCFVSTAFT 260        270        280        290        300
                 ....|....|....|....|....|....|....|....|....|....|
NOV6             VLTFLLEPHRFQYPERPIIFLSMCYNVYSLAFLIRAVAGAQSVACDQEAG
gi|12861958|     VFTFLLEPHRFQYPERPIIFLSMCYNVYSLAFLIRAVAGAQSVACDQEAG
gi|17433078|     VFTFLLEPHRFQYPERPIIFLSMCYNVYSLAFLIRAVAGAQSVACDQEAG
gi|4503835|      VLTFLLEPHRFQYPERPIIFLSMCYNVYSLAFLIRAVAGAQSVACDQEAG
gi|5042380|      VFTFLLEPHRFQYPERPIIFLSMCYNVYSLAFLIRAVAGAQSVACDQEAG
gi|9622217|      VLTFLLDPHRFQYPERPIIFLSMCYNVYSVAFIIRSVAGAENIACDRENG 310        320        330        340        350
                 ....|....|....|....|....|....|....|....|....|....|
NOV6             ALYVIQEGLENTGCTLVFLLLYYFGMASSLWWVVLTLTWFLAAGKKWGHE
gi|12861958|     ALYVIQEGLENTGCTLVFLLLYYFGMASSLWWVVLTLTWFLAAGKKWGHE
gi|17433078|     ALYVIQEGLENTGCTLVFLLLYYFGMASSLWWVVLTLTWFLAAGKKWGHE
gi|4503835|      ALYVIQEGLENTGCTLVFLLLYYFGMASSLWWVVLTLTWFLAAGKKWGHE
gi|5042380|      ALYVIQEDLENTGCTLVFLLLYYFGMASSLWWVVLTLTWFLAAGKKWGHE
gi|9622217|      ELYTIQEGLESTGCTIVFLRLYYFGMASSIWWVILTLTWFLAAGKKWGHE 360        370        380        390        400
                 ....|....|....|....|....|....|....|....|....|....|
NOV6             AIEAHGSYFHMAAWGLPALKTIVILTLRKVAGDELTGLCYVASTDAAALT
gi|12861958|     AIEAHGSYFHMAAWGLPALKTIVVLTLRKVAGDELTGLCYVASMDPAALT
gi|17433078|     AIEAHGSYFHMAAWGLPALKTIVVLTLRKVAGDELTGLCYVASMDPAALT
gi|4503835|      AIEAHGSYFHMAAWGLPALKTIVILTLRKVAGDELTGLCYVASTDAAALT
gi|5042380|      AIEAHGSYFHMAAWGLPALKTIVVLTLRKVAGDELTGLCYVASMDPAALT
gi|9622217|      AIESHSSYFHMAAWGIPALKTIVFLTMRKVAGDELTGLCYVGSMDVGALT 410        420        430        440        450
                 ....|....|....|....|....|....|....|....|....|....|
NOV6             GFVLVPLSCYLVLGSSFLLTGFVALFHIRKIMKTGGTNTEKLEKLMVKIG
gi|12861958|     GFVLVPLSCYLVLGTSFLLTGFVALFHIRKIMKTGGTNTEKLEKLMVKIG
gi|17433078|     GFVLVPLSCYLVLGTSFLLTGFVALFHIRKIMKTGGTNTEKLEKLMVKIG
gi|4503835|      GFVLVPLSCYLVLGSSFLLTGFVALFHIRKIMKTGGTNTEKLEKLMVKIG
gi|5042380|      GFVLVPLSCYLVLGTSFLLTGFVALFHIRKIMKTGGTNTEKLEKLMVKIG
gi|9622217|      GFVLVPLSCYLVIGTSFRLTGFVALFHIRKVMKTEGTNTEKLEKLMVKIG 460        470        480        490        500
                 ....|....|....|....|....|....|....|....|....|....|
NOV6             VFSILYTVPATCVIVCYVYERLKMDFWRLRATEQPCAAAGPGGRR-DCS
gi|12861958|     VFSILYTVPATCVIVCYVYERLKMDFWRLRATEQPCTAATVPGGRR-DCS
gi|17433078|     VFSILYTVPATCVIVCYVYERLKMDFWRLRATEQPCAAAGPGGRR-DCS
gi|4503835|      VFSILYTVPATCVIVCYVYERLKMDFWRLRATEQPCAAAGPGGRR-DCS
gi|5042380|      VFSILYTVPATCVIVCYVYERLKMDFWRLRATEQPCTAATVPGGRR-DCS
gi|9622217|      IYSILYTVPATCVIICYFYERLNMDYWKFRGLQSKCT--IFPGRRNEDCS 510        520        530        540        550
                 ....|....|....|....|....|....|....|....|....|....|
NOV6             LPGGSVPTVAVFMLKIFMSLVVGITSGVWVWSSKTFQTWQSLCYRKIAAG
gi|12861958|     LPGGSVPTVAVFMLKIFMSLVVGITSGVWVWSSKTFQTWQSLCYRKMAAG
gi|17433078|     LPGGSVPTVAVFMLKIFMSLVVGITSGVWVWSSKTFQTWQSLCYRKIAAG
gi|4503835|      LPGGSVPTVAVFMLKIFMSLVVGITSGVWVWSSKTFQTWQSLCYRKIAAG
gi|5042380|      LPGGSVPTVAVFMLKIFMSLVVGITSGVWVWSSKTFQTWQSLCYRKMAAG
gi|9622217|      LDS-SVPTVAVFELKIFMSLVVGITSGVWVWSSKTLQTWQGLCSRKITD- 560        570        580        590
                 ....|....|....|....|....|....|....|....|....|
NOV6             RARAKACRAPGSYGRGTHCHYKAPTVVLHMTKTDPSLENPTHL
gi|12861958|     RARAKACRTPGGYGRGTHCHYKAPTVVLHMTKTDPSLENPTHP
gi|17433078|     RARAKACRTPGGYGRGTHCHYKAPTVVLHMTKTDPSLENPTHL
gi|4503835|      RARAKACRAPGSYGRGTHCHYKAPTVVLHMTKTDPSLENPTHL
gi|5042380|      RARAKACRTPGGYGRGTHCHYKAPTVVLHMTKTDPSLENPTHL
gi|9622217|      RTCRKHCSTS-------HCHYKAEAVILHMSKTDPYSDCPTHV
```

Tables 18E list the domain description from DOMAIN analysis results against NOV6.

This indicates that the NOV6 sequence has properties similar to those of other proteins known to contain this domain.

TABLE 18E

Domain Analysis of NOV6 gnl|Pfam|pfam01534, Frizzled, Frizzled CD-Length = 328 residues, 98.5% aligned Score = 440 bits (1131), Expect = 1e−124

Epithelial cell differentiation and morphogenesis are crucial in many aspects of metazoan development. Recent genetic studies in Drosophila have revealed that the conserved Jun amino-terminal kinase (JNK) signaling pathway regulates epithelial morphogenesis during the process of embryonic dorsal closure and participates in the control of planar polarity in several tissues. Importantly, these studies have linked the JNK pathway to the decapentaplegic and Frizzled pathways in these processes, suggesting a high degree of integrative signaling during epithelial morphogenesis. (See Noselli et al., 1999, Curr Opin Genet Dev 9:466–72).

The wnt signaling pathway has important functions in nervous system development. To better understand this process we have cloned and analyzed the expression of the wnt receptor, frizzled 9, in the developing nervous system in mouse, chick and zebrafish. The earliest expression of mouse frizzled 9 mRNA expression begins at E8.5 with expression throughout the entire rostral-caudal neuraxis. This early expression pattern within the neural tube appears to be conserved between chick and zebrafish. Expression becomes restricted to a ventral domain in the mouse ventricular zone at E11.5, a region specified to give rise to neurons and glia. Using a polyclonal antibody to MFZ9 further shows expression limited to neural restricted precursors cells. (See Van Ray et al., 2001, Dev Genes Evol, 211(8–9):453–7).

The disclosed NOV6 nucleic acid of the invention encoding a Frizzled-9-like protein includes the nucleic acid whose sequence is provided in Table 18A or a fragment thereof. The invention also includes a mutant or variant nucleic acid any of whose bases may be changed from the corresponding base shown in Table 18A while still encoding a protein that maintains its Frizzled-9-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 5 percent of the bases may be so changed.

The disclosed NOV6 protein of the invention includes the Frizzled-9-like protein whose sequence is provided in Table 18B. The invention also includes a mutant or variant protein any of whose residues may be changed from the corresponding residue shown in Table 18B while still encoding a protein that maintains its Frizzled-9-like activities and physiological functions, or a functional fragment thereof. In the mutant or variant protein, up to about 5 percent of the residues may be so changed.

The above defined information for this invention suggests that these Frizzled-9-like proteins (NOV6) may function as a member of a "Frizzled-9 family". Therefore, the NOV6 nucleic acids and proteins identified here may be useful in potential therapeutic applications implicated in (but not limited to) various pathologies and disorders as indicated below. The potential therapeutic applications for this invention include, but are not limited to: protein therapeutic, small molecule drug target, antibody target (therapeutic, diagnostic, drug targeting/cytotoxic antibody), diagnostic and/or prognostic marker, gene therapy (gene delivery/gene ablation), research tools, tissue regeneration in vivo and in vitro of all tissues and cell types composing (but not limited to) those defined here.

The nucleic acids and proteins of NOV6 are useful in ulcerative colitis, Crohn's disease, recessive Robinow syndrome, cancer and/or other pathologies/disorders.

NOV6 nucleic acids and polypeptides are further useful in the generation of antibodies that bind immunospecifically to the novel substances of the invention for use in therapeutic or diagnostic methods. These antibodies may be generated according to methods known in the art, using prediction from hydrophobicity charts, as described in the "Anti-NOVX Antibodies" section below. For example the disclosed NOV6 protein have multiple hydrophilic regions, each of which can be used as an immunogen. This novel protein also has value in development of powerful assay system for functional analysis of various human disorders, which will help in understanding of pathology of the disease and development of new drug targets for various disorders.

NOV7

A disclosed NOV nucleic acid of 2523 nucleotides (also referred to CG55117-01) encoding a novel prominin-like protein is shown in Table 19A.

TABLE 19A

NOV7 Nucleotide Sequence (SEQ ID NO:37)

GGATCCGGAGGGCAGCCTTCATCCACAGATGCTCCTAAGGCTTGGAATTATGAATTGCCTGCAACAAATTATGAGACCCAAGAC

TCCCATAAAGCTGGACCCATTGGCATTCTCTTTGAACTAGTGCATATCTTTCTCTATGTGGTACAGCCGCGTGATTTCCCAGAA

GATACTTTGAGAAAATTCTTACAGAAGGCATATGAATCCAAAATTGATTATGACAAGATTGTCTACTATGAAGCAGGGATTATT

CTATGCTGTGTCCTGGGGCTGCTGTTTATTATTCTGATGCCTCTGGTGGGGTATTTCTTTTGTATGTGTCGTTGCTGTAACAAA

TGTGGTGGAGAAATGCACCAGCGACAGAAGGAAAATGGGCCCTTCCTGAGGAAATGCTTTGCAATCTCCCTGTTGGTGATTTGT

TABLE 19A-continued

NOV7 Nucleotide Sequence

ATAATAATAAGCATTGGCATCTTCTATGGTTTTGTGGCAAATCACCAGGTAAGAACCCGGATCAAAAGGAGTCGGAAACTGGCA

GATAGCAATTTCAAGGACTTGCGAACTCTCTTGAATGAAACTCCAGAGCAAATCAAATATATATTGGCCCAGTACAACACTACC

AAGGACAAGGCGTTCACAGATCTGAACAGTATCAATTCAGTGCTAGGAGGCGGAATTCTTGACCGACTGAGACCCAACATCATC

CCTGTTCTTGATGAGATTAAGTCCATGGCAACAGCGATCAAGGAGACCAAAGAGGCGTTGGAGAACATGAACAGCACCTTGAAG

AGCTTGCACCAACAAAGTACACAGCTTAGCAGCAGTCTGACCAGCGTGAAAACTAGCCTGCGGTCATCTCTCAATGACCCTCTG

TGCTTGGTGCATCCATCAAGTGAAACCTGCAACAGCATCAGATTGTCTCTAAGCCAGCTGAATAGCAACCCTGAACTGAGGCAG

CTTCCACCCGTGGATGCAGAACTTGACAACGTTAATAACGTTCTTAGGACAGATTTGGATGGCCTGGTCCAACAGGGCTATCAA

TCCCTTAATGATATACCTGACAGAGTACAACGCCAAACCACGACTGTCGTAGCAGGTATCAAAAGGGTCTTGAATTCCATTGGT

TCAGATATCGACAATGTAACTCAGCGTCTTCCTATTCAGGATATACTCTCAGCATTCTCTGTTTATGTTAATAACACTGAAAGT

TACATCCACAGAAATTTACCTACATTGGAAGAGTATGATTCATACTGGTGGCTGGGTGGCCTGGTCATCTGCTCTCTGCTGACC

CTCATCGTGATTTTTTACTACCTGGGCTTACTGTGTGGCGTGTGCGGCTATGACAGGCATGCCACCCCGACCACCCGAGGCTGT

GTCTCCAACACCGGAGGCGTCTTCCTCATGGTTGGAGTTGGATTAAGTTTCCTCTTTTGCTGGATATTGATGATCATTGTGGTT

CTTACCTTTGTCTTTGGTGCAAATGTGGAAAAACTGATCTGTGAACCTTACACGAGCAAGGAATTATTCCGGGTTTTGGATACA

CCCTACTTACTAAATGAAGACTGGGAATACTATCTCTCTGGGAAGCTATTTAATAAATCAAAAATGAAGCTCACTTTTGAACAA

GTTTACAGTGACTGCAAAAAAAATAGAGGCACTTACGGCACTCTTCACCTGCAGAACAGCTTCAATATCAGTGAACATCTCAAC

ATTAATGAGCATACTGGAAGCATAAGCAGTGAATTGGAAAGTCTGAAGGTAAATCTTAATATCTTTCTGTTGGGTGCAGCAGGA

AGAAAAAACCTTCAGGATTTTGCTGCTTGTGGAATAGACAGAATGGATTATGACAGCTACTTGGCTCAGACTGGTAAATCCCCC

GCAGGAGTGAATCTTTTATCATTTGCATATGATCTAGAAGCAAAAGCAAACAGTTTGCCCCCAGGAAATTTGAGGAACTCCCTG

AAAAGAGATGCACAAACTATTAAAACAATTCACCAGCAACGAGTCCTTCCTATAGAACAATCACTGAGCACTCTATACCAAAGC

GTCAAGATACTTCAACGCACAGGGAATGGATTGTTGGAGAGAGTAACTAGGACTCTAGCTTCTCTGGATTTTGCTCAGAACTTC

ATCACAAACAATACTTCCTCTGTTATTATTGAGGAAACTAAGAAGTATGGGAGGACAATAATAGGATATTTTGAACATTATCTG

CAGTGGATCGAGTTCTCTATCAGTGAGAAAGTGGCATCGTGCAAACCTGTGGCCACCGCTCTAGATACTGCTGTTGATGTCTTT

CTGTGTAGCTACATTATCGACCCCTTGAATTTGTTTTGGTTTGGCATAGGAAAAGCTACTGTATTTTTACTTCCGGCTCTAATT

TTTGCGGTAAAACTGGCTAAGTACTATCGTCGAATGGATTCGGAGGACGTGTACGATGATGTTGAAACTATACCCATGAAAAAT

ATGGAAAATGGTAATAATGGTTATCATAAAGATCATGTATATGGTATTCACAATCCTGTTATGACAAGCCCATCACAACATCTC

GAG

A disclosed NOV7 polypeptide (SEQ ID NO:38) encoded by SEQ ID NO:37 is 837 amino acid residues and is presented using the one-letter amino acid code in Table 19B. Signal P, Psort and/or Hydropathy results predict that NOV7 has no signal peptide and is likely to be localized in the plasma membrane with a certainty of 0.6400. In other embodiments, NOV7 is also likely to be localized to the Golgi body with a certainty of 0.4000, in the endoplasmic reticulum (membrane) with a certainty of 0.300, or to the mitochondrial inner membrane with a certainty of 0.1000.

TABLE 19B

Encoded NOV7 protein sequence.

GGQPSSTDAPKAWNYELPATNYETQDSHKAGPIGILFELVHIFLYVVQPRDFPEDTLRKF (SEQ ID NO:38)

LQKAYESKIDYDKIVYYEAGIILCCVLGLLFIILMPLVGYFFCMCRCCNKCGGEMHQRQK

ENGPFLRKCFAISLLVICIIISIGIFYGFVANHQVRTRIKRSRKLADSNFKDLRTLLNET

PEQIKYILAQYNTTKDKAFTDLNSINSVLGGGILDRLRPNIIPVLDEIKSMATAIKETKE

ALENMNSTLKSLHQQSTQLSSSLTSVKTSLRSSLNDPLCLVHPSSETCNSIRLSLSQLNS

TABLE 19B-continued

Encoded NOV7 protein sequence.

NPELRQLPPVDAELDNVNNVLRTDLDGLVQQGYQSLNDIPDRVQRQTTTVVAGIKRVLNS

IGSDIDNVTQRLPIQDILSAFSVYVNNTESYIHRNLPTLEEYDSYWWLGGLVICSLLTLI

VIFYYLGLLCGVCGYDRHATPTTRGCVSNTGGVFLMVGVGLSFLFCWILMIIVVLTFVFG

ANVEKLICEPYTSKELFRVLDTPYLLNEDWEYYLSGKLFNKSKMKLTFEQVYSDCKKNRG

TYGTLHLQNSFNISEHLNINEHTGSISSELESLKVNLNIFLLGAAGRKNLQDFAACGIDR

MDYDSYLAQTGKSPAGVNLLSFAYDLEAKANSLPPGNLRNSLKRDAQTIKTIHQQRVLPI

EQSLSTLYQSVKILQRTGNGLLERVTRTLASLDFAQNFITNNTSSVIIEETKKYGRTIIG

YFEHYLQWIEFSISEKVASCKPVATALDTAVDVFLCSYIIDPLNLFWFGIGKATVFLLPA

LIFAVKLAKYYRRMDSEDVYDDVETIPMKNMENGNNGYHKDHVYGIHNPVMTSPSQH

NOV7 is expressed in at least the following tissues: ovary. This information was derived by determining the tissue sources of the sequences that were included in the invention including but not limited to SeqCalling sources, Public EST sources, Literature sources, and/or RACE sources.

NOV7 has homology to the amino acid sequence shown in the BLASTP data listed in Table 19C.

TABLE 19C

BLAST results for NOV7

| Gene Index/ Identifier | Protein/Organism | Length (aa) | Identity (%) | Positives (%) | Expect |
|---|---|---|---|---|---|
| gb\|AAH12089.1\| AAH12089 (BC012089) | Similar to prominin (mouse) - like 1 [Homo sapiens] | 856 | 99 | 99 | 0.0 |
| sp\|O43490\|PML1_HUMAN | Human PROMININ-LIKE PROTEIN 1 PRECURSOR (ANTIGEN AC133) | 865 | 99 | 99 | 0.0 |
| gb\|AAK82364.1\| AF386758_1 (AF386758) | prominin [Rattus norvegicus] | 857 | 61 | 79 | 0.0 |
| gb\|AAB96916.1\| (AF039663) | AC133 antigen homolog [Mus musculus] | 867 | 60 | 78 | 0.0 |
| ref\|NP_032961.1\| (NM_008935) | prominin [Mus musculus] | 858 | 60 | 78 | 0.0 |

The homology of these sequences is shown graphically in the ClustalW analysis shown in Table 19D.

TABLE 7D

Information for the ClustalW proteins

```
1) NOV7              (SEQ ID NO:38)
2) gb|AAH12089.1|    (SEQ ID NO:131)
3) ref|NP_006008.1|  (SEQ ID NO:132)
4) gb|AAK82364.1|    (SEQ ID NO:133)
5) sp|O54990|        (SEQ ID NO:134)
6) ref|NP_032961.1|  (SEQ ID NO:135)
```

```
                              10         20         30         40         50
                     ....|....|....|....|....|....|....|....|....|....|
NOV7                 --------------------------------------------------
gb|AAH12089.1|       MALVLGSLLLLGLCGNSFSGGQPSSTDAPKAWNYELPAINYETQDSHKAG
ref|NP_006008.1|     MALVLGSLLLLGLCGNSFSGGQPSSTDAPKAWNYELPAINYETQDSHKAG
gb|AAK82364.1|       MALVFSVLLLLGLCGKMASGGQPAFDNTPGALNYELPTIEYETQDTFNAG
sp|O54990|           MALVFSALLLLGLCGKISSEGQPAFHNTPGAMNYELPTIKYETQDTFNAG
ref|NP_032961.1|     MALVFSALLLLGLCGKISSEGQPAFHNTPGAMNYELPTIKYETQDTFNAG
```

TABLE 7D-continued

Information for the ClustalW proteins

```
                        60         70         80         90        100
                 ....|....|....|....|....|....|....|....|....|....|
NOV7             --------------------------------------------------
gb|AAH12089.1|   PIGILFELVHIFLYVVQPRDFPEDTLRKFLQKA-YESKIDYDK-------
ref|NP_006008.1| PIGILFELVHIFLYVVQPRDFPEDTLRKFLQKA-YESKIDYDKPETVILG
gb|AAK82364.1|   IIDPLYQMVHIFLNVVQPNDFPQDLVKKLIQKR-FDISVDTKE-------
sp|O54990|       IVGPLYKMVHIFLSVVQPNDFPLDLIKKKLIQNKKFDISVDSKEPEIIVLA
ref|NP_032961.1| IVGPLYKMVHIFLNVQPNDFPLDLIKKLIQNKNFDISVDSKK-------

110        120        130        140        150
                 ....|....|....|....|....|....|....|....|....|....|
NOV7             -------------------------------------------------E
gb|AAH12089.1|   --IVYYEAGIILCCVLGLLFIILMPLVGYFFCMCRCCNKCGGEMHQRQKE
ref|NP_006008.1| LKIVYYEAGIILCCVLGLLFIILMPLVGYFFCMCRCCNKCGGEMHQRQKE
gb|AAK82364.1|   --VAIYEIGVLICVLGLLFIFLMPLVGFFFCMCTCNKCGGEMHQRQKQ
sp|O54990|       LKIALYEIGVLICALGLLFIILMPLVGCFFCMCTCCNKCGGEMHQRQKQ
ref|NP_032961.1| --IALYEIGVLICALGLLFIILMPLVGCFFCMCTCCNKCGGEMHQRQKQ 160        170        180        190        200
                 ....|....|....|....|....|....|....|....|....|....|
NOV7             NGPFLRKCFAISLLVICIISIGIFYGFVANHQVRTRIKRSRKLADSNFK
gb|AAH12089.1|   NGPFLRKCFAISLLVICIISIGIFYGFVANHQVRTRIKRSRKLADSNFK
ref|NP_006008.1| NGPFLRKCFAISLLVICIISIGIFYGFVANHQVRTRIKRSRKLADSNFK
gb|AAK82364.1|   NESCRRKCLAISLLILCLLMSLGIAFGFVANQQTRTRIQRTQKLAESNYR
sp|O54990|       NAPCRRKCLGISLLVICLLMSLGIIYGFVANQQTRTRIKGTQKLAKSNFR
ref|NP_032961.1| NAPCRRKCLGISLLVICLLMSLGIIYGFVANQQTRTRIKGTQKLAKSNFR 210        220        230        240        250
                 ....|....|....|....|....|....|....|....|....|....|
NOV7             DLRTLLNETPEQIKYILAQYNTTKDKAFTDLNSIRSVLGGGILDRLRPNI
gb|AAH12089.1|   DLRTLLNETPEQIKYILAQYNTTKDKAFTDLNSIRSVLGGGILDRLRPNI
ref|NP_006008.1| DLRTLLNETPEQIKYILAQYNTTKDKAFTDLNSIRSVLGGGILDRLRPNI
gb|AAK82364.1|   DLRALLTEAPKQIDYILQGYNTTKNKAFSDLDSIDSVLGGGILDRLRPNI
sp|O54990|       DFQTLLTETPKQIDYVVEQYTNTKNKAFSDLDGIGSVLGGRIKDQLKPKV
ref|NP_032961.1| DFQTLLTETPKQIDYVVEQYTNTKNKAFSDLDGIGSVLGGRIKDQLKPKV 260        270        280        290        300
                 ....|....|....|....|....|....|....|....|....|....|
NOV7             IPVLEEIKSMATAIKETKEALENMNSTLKSLHQQSTQLSSSLTSVKTSLR
gb|AAH12089.1|   IPVLEEIKSMATAIKETKEALENMNSTLKSLHQQSTQLSSSLTSVKTSLR
ref|NP_006008.1| IPVLEEIKSMATAIKETKEALENMSTLKSLHQQSTQLSSSLTSVKTSLR
gb|AAK82364.1|   TPVLEEIKAMATAIRQTKDALQNMSSSLKSLRDASTQLSTNLTSVRNSTE
sp|O54990|       TPVLEEIKMATAIKQTKDALQNMSSSLKSLQDAATQLNTNLSSVRNSIE
ref|NP_032961.1| TPVLEEIKAMATAIKQTKDALQNMSSSLKSLQDAATQLNTNLSSVRNSIE 310        320        330        340        350
                 ....|....|....|....|....|....|....|....|....|....|
NOV7             SSLNDPLCLVHPSSETCNSIRLSLSQLNSNPELRQLPPVDAELDNVNNVL
gb|AAH12089.1|   SSLNDPLCLVHPSSETCNSIRLSLSQLNSNPELRQLPPVDAELDNVNNVL
ref|NP_006008.1| SSLNDPLCLVHPSSETCNSIRLSLSQLNSNPELRQLPPVDAELDNVNNVL
gb|AAK82364.1|   NSLNSNDCASDPASKICDSLRPQLSNLGSNHNGSQLPSVDRELNTVNDVD
sp|O54990|       NSLSSSDCTSDPASKICDSIRPSLSSSLGSSLNSSQLPSVDRELNTVTEVD
ref|NP_032961.1| NSLSSSDCTSDPASKICDSIRPSLSSSLGSSLNSSQLPSVDRELNTVTEVD 360        370        380        390        400
                 ....|....|....|....|....|....|....|....|....|....|
NOV7             RTDLDGLVQQGYQSLNDIPDRVQRQTTTVAGIKRVLNSIGSDIDNVTQR
gb|AAH12089.1|   RTDLDGLVQQGYQSLNDIPDRVQRQTTTVAGIKRVLNSIGSDIDNVTQR
ref|NP_006008.1| RTDLDGLVQQGYQSLNDIPDRVQRQTTTVAGIKRVLNSIGSDIDNVTQR
gb|AAK82364.1|   RTDLESLVKRGYMSIDEIPNMIQNQTGDVIKDVKKTLDSVSSKVKNMSQS
sp|O54990|       KTDLESLVKRGYTTIDEIPNTIQNQTVDVIKDVKNTLDSISSNIKDMSQS
ref|NP_032961.1| KTDLESLVKRGYTTIDEIPNTIQNQTVDVIKDVKNTLDSISSNIKDMSQS 410        420        430        440        450
                 ....|....|....|....|....|....|....|....|....|....|
NOV7             LPIQDILSAFSVYYNNTESYIHRNLPTLEEYDSYWWLGGIVICSLLTLIV
gb|AAH12089.1|   LPIQDILSAFSVYYNNTESYIHRNLPTLEEYDSYWWLGGIVICSLLTLIV
ref|NP_006008.1| LPIQDILSAFSVYYNNTESYIHRNLPTLEEYDSYWWLGGIVICSLLTLIV
gb|AAK82364.1|   IPVEEVLLQFSHYLNDSNRYTHESLPRVEEYDSYWWLGGIIVCFLLTLIV
sp|O54990|       IPIEDMLLQVSHYLNSNRMLNQEPKLEEYDSYWWLGGIIVCFLLTLIV
ref|NP_032961.1| IPIEDMLLQVSHYLNNSNRMLNQEPKLEEYDSYWWLGGIIVCFLLTLIV
```

TABLE 7D-continued

Information for the ClustalW proteins

```
                      460       470       480       490       500
                 ....|....|....|....|....|....|....|....|....|....|
NOV7             IFYYLGLLCGVCGYDRHATPTTRGCVSNTGGVFLMVGVGLSFLFCWILMI
gb|AAH12089.1|   IFYYLGLLCGVCGYDRHATPTTRGCVSNTGGVFLMVGVGLSFLFCWILMI
ref|NP_006008.1| IFYYLGLLCGVCGYDRHATPTTRGCVSNTGGVFLMVGVGLSFLFCWILMI
gb|AAK82364.1|   TFFYLGLLCGVFGYDKRATPTRRGCVSNTGGIFLMAGVGFSFLFCWILMI
sp|O54990|       TFRFLGLLCGVFGYDKHATPTRRGCVSNTGGIFLMAGVGFGFLFCWILMI
ref|NP_032961.1| TFRFLGLLCGVFGYDKHATPTRRGCVSNTGGIFLMAGVGFGFLFCWILMI 510       520       530       540       550
                 ....|....|....|....|....|....|....|....|....|....|
NOV7             IVVLTFVFGANVEKLICEPYTSKELFRVLDTPYLLNEDWEYYLSGKLFNK
gb|AAH12089.1|   IVVLTFVFGANVEKLICEPYTSKELFRVLDTPYLLNEDWEYYLSGKLFNK
ref|NP_006008.1| IVVLTFVFGANVEKLICEPYTSKELFRVLDTPYLLNEDWEYYLSGKLFNK
gb|AAK82364.1|   LVVLTFVVGANVEKLICEPYENKKLLQVLDTPYLLNDQWQFYLSGILLKN
sp|O54990|       LVVLTFVVGANVEKLICEPYENKKLLQVLDTPYLLKEQWQFYLSGMLFNN
ref|NP_032961.1| LVVLTFVVGANVEKLICEPYENKKLLQVLDTPYLLKEQWQFYLSGMLFNN 560       570       580       590       600
                 ....|....|....|....|....|....|....|....|....|....|
NOV7             SKMKLTFEQVYSDCKKNRGTYGLLHLQNSFNISEHLNINEHTGSISSELE
gb|AAH12089.1|   SKMKLTFEQVYSDCKKNRGTYGLLHLQNSFNISEHLNINEHTGSISSELE
ref|NP_006008.1| SKMKLTFEQVYSDCKKNRGTYGLLHLQNSFNISEHLNINEHTGSISSELE
gb|AAK82364.1|   PDINMTFEQVYRDCKRGRGVYALFQLENVFNITENFNIERLSEDIVKELE
sp|O54990|       PDINMTFEQVYRDCKRGRGIYAAFQLENVVNVSDFNIDQISENINTELE
ref|NP_032961.1| PDINMTFEQVYRDCKRGRGIYAAFQLENVVNVSDFNIDQISENINTELE 610       620       630       640       650
                 ....|....|....|....|....|....|....|....|....|....|
NOV7             SLKVNLN-IFLLGAAGRKNLQDFAACGIDRMDYDSYLAQIGKSPAGVNLL
gb|AAH12089.1|   SLKVNLN-IFLLGAAGRKNLQDFAACGIDRMNYDSYLAQIGKSPAGVNLL
ref|NP_006008.1| SLKVNLN-IFLLGAAGRKNLQDFAACGIDRMNYDSYLAQIGKSPAGVNLL
gb|AAK82364.1|   KLNVNIDSIELLDKTGRKSLEDFAQSGIDRINYSMYLQEAEKPPTHVDLL
sp|O54990|       NLNVNIDSIELLDNTGRKSLEDFAHSGIDTIDYSTYLKETEKSPTEVNLL
ref|NP_032961.1| NLNVNIDSIELLDNTGRKSLEDFAHSGIDTIDYSTYLKETEKSPTEVNLL 660       670       680       690       700
                 ....|....|....|....|....|....|....|....|....|....|
NOV7             SFAYDLEAKANSLPPGNLRNSLKRDAQTIKTIHQQRVLPIEQSLTLYQS
gb|AAH12089.1|   SFAYDLEAKANSLPPGNLRNSLKRDAQTIKTIHQQRVLPIEQSLTLYQS
ref|NP_006008.1| SFAYDLEAKANSLPPGNLRNSLKRDAQTIKTIHQQRVLPIEQSLTLYQS
gb|AAK82364.1|   IFASFLETEANQLPDGNLKQAFLMDAQNIRAIHQQHVPPVQQSLNSLKQS
sp|O54990|       IFASTLEAKANQLPEGKPKQAFLLDVQNIRAIHQLLPPVQQSLNTLRQS
ref|NP_032961.1| IFASTLEAKANQLPEGKLKQAFLLDVQNIRAIHQHLLPPVQQSLNTLRQS 710       720       730       740       750
                 ....|....|....|....|....|....|....|....|....|....|
NOV7             VKILQRIGNGLLERVTRTLASLDFAQNFITNNTSSVIIEETKKYGRTIIG
gb|AAH12089.1|   VKILQRIGNGLLERVTRILASLDFAQNFITNNTSSVIIEETKKYGRTIIG
ref|NP_006008.1| VKILQRIGNGLLERVTRILASLDFAQNFITNNTSSVIIEETKKYGRTIIG
gb|AAK82364.1|   VWALKQISSKLPEEVKKVLASLDSAQHFIISNLSSIVIGETKKFGRTIIG
sp|O54990|       VWTLQQISNKLPEKVKKILASLDSVQHFLTNNVSLIVIGETKKFGKTIIG
ref|NP_032961.1| VWTLQQISNKLPEKVKKILASLDSVQHFLTNNVSLIVIGETKKFGKTIIG 760       770       780       790       800
                 ....|....|....|....|....|....|....|....|....|....|
NOV7             YFEHYLQWIEFSISEKVASCKPVATALDTAVDVFLCSYIIDPLNLFWFGI
gb|AAH12089.1|   YFEHYLQWLEFSISEKVASCKPVATALDTAVDVFLCSYIIDPLNLFWFGI
ref|NP_006008.1| YFEHYLQWLEFSISEKVASCKPVATALDTAVDVFLCSYIIDPLNLFWFGI
gb|AAK82364.1|   YFEHYLQWVLYAITEKMTSCKPMIATAMDSAVNGILCSYVADPLNLFWFGI
sp|O54990|       YFEHYLHWVFYAITEKMTSCKPMATAMDSAVNGILCGYVADPLNLFWFGI
ref|NP_032961.1| YFEHYLHWVFYAITEKMTSCKPMATAMDSAVNGILCGYVADPLNLFWFGI 810       820       830       840       850
                 ....|....|....|....|....|....|....|....|....|....|
NOV7             GKATVFLLPALIFAVKLAKYYRRMDSEDVYDDVETIPMKNMENGNNGYHK
gb|AAH12089.1|   GKATVFLLPALIFAVKLAKYYRRMDSEDVYDDVETIPMKNMENGNNGYHK
ref|NP_006008.1| GKATVFLLPALIFAVKLAKYYRRMDSEDVYDDVETIPMKNMENGNNGYHK
gb|AAK82364.1|   GKATMLLLPAVIIAIKLAKYYRRMDSEDVYDDVETVPMKNLENGNNGYHK
sp|O54990|       GKATVLLLPAVIIARKLAKYYRRMDSEDVYDDVETVPMKNLEIGSNGYHK
ref|NP_032961.1| GKATVLLLPAVIIARKLAKYYRRMDSEDVYDDVETVPMKNLEIDSNGYHK
```

TABLE 7D-continued

Information for the ClustalW proteins

```
                                    860
                          ....|....|....|..
NOV7                      DHVYGIHNPVMTSPSQH
gb|AAH12089.1|            DHVYGIHNPVMTSPSQH
ref|NP_006008.1|          DHVYGIHNPVMTSPSQH
gb|AAK82364.1|            DHLYGVHNPVMTSPSRY
sp|O54990|                DHLYGVHNPVMTSPSRY
ref|NP_032961.1|          DHLYGVHNPVMTSPSRY
```

Prominin is the first identified member of a novel family of polytopic membrane proteins conserved throughout the animal kingdom. It has an unusual membrane topology, containing five transmembrane domains and two large glycosylated extracellular loops. In mammals, prominin is expressed in various embryonic and adult epithelial cells, as well as in nonepithelial cells, such as hematopoietic stem cells. At the subcellular level, prominin is selectively localized in microvilli and other plasma membrane protrusions, irrespective of cell type. At the molecular level, prominin specifically interacts with membrane cholesterol and is a marker of a novel type of cholesterol-based lipid 'raft'. A frameshift mutation in the human prominin gene, which results in a truncated protein that is no longer transported to the cell surface, is associated with retinal degeneration. Given that prominin is concentrated in the plasma membrane evaginations at the base of the outer segment of rod photoreceptor cells, which are essential precursor structures in the biogenesis of photoreceptive disks, it is proposed that prominin has a role in the generation of plasma membrane protrusions, their lipid composition and organization and their membrane-to-membrane interactions. (See 50 Corbeil et al., 2001, Traffic 2(2):82–91).

The disclosed NOV7 nucleic acid of the invention encoding a prominin-like protein includes the nucleic acid whose sequence is provided in Table 19A or a fragment thereof. The invention also includes a mutant or variant nucleic acid any of whose bases may be changed from the corresponding base shown in Table 19A while still encoding a protein that maintains its prominin-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 5 percent of the bases may be so changed.

The disclosed NOV7 protein of the invention includes the prominin-like protein whose sequence is provided in Table 19B. The invention also includes a mutant or variant protein any of whose residues may be changed from the corresponding residue shown in Table 7B while still encoding a protein that maintains its prominin-like activities and physiological functions, or a functional fragment thereof. In the mutant or variant protein, up to about 5 percent of the residues may be so changed.

The protein similarity information, expression pattern, and map location for the prominin-like protein and nucleic acid (NOV7) disclosed herein suggest that NOV7 may have important structural and/or physiological functions characteristic of the prominin-like family. Therefore, the NOV7 nucleic acids and proteins of the invention are useful in potential diagnostic and therapeutic applications. These include serving as a specific or selective nucleic acid or protein diagnostic and/or prognostic marker, wherein the presence or amount of the nucleic acid or the protein are to be assessed, as well as potential therapeutic applications such as the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/gene ablation), and (v) a composition promoting tissue regeneration in vitro and in vivo.

The NOV7 nucleic acids and proteins of the invention are useful in potential diagnostic and therapeutic applications implicated in various diseases and disorders described below and/or other pathologies. For example, the compositions of the present invention will have efficacy for treatment of patients suffering from neurological disorders, cholesterol transport disorders, retinal degeneration and/or other pathologies/disorders. The NOV7 nucleic acid, or fragments thereof, may further be useful in diagnostic applications, wherein the presence or amount of the nucleic acid or the protein are to be assessed.

NOV7 nucleic acids and polypeptides are further useful in the generation of antibodies that bind immunospecifically to the novel substances of the invention for use in therapeutic or diagnostic methods. These antibodies may be generated according to methods known in the art, using prediction from hydrophobicity charts, as described in the "Anti-NOVX Antibodies" section below. For example the disclosed NOV7 protein have multiple hydrophilic regions, each of which can be used as an immunogen. This novel protein also has value in development of powerful assay system for functional analysis of various human disorders, which will help in understanding of pathology of the disease and development of new drug targets for various disorders.

NOV8

A disclosed NOV8 nucleic acid of 2363 nucleotides identified as SEQ ID NO:39 (also referred to as CG55606) encoding a novel hepsin-like protein is shown in Table 20A.

TABLE 20A

NOV8 nucleotide sequence.

(SEQ ID NO:39)
AATCAAAACCATCTTTATTATTTAAAGAGCATCCCATCATCAGGGGCACCTAGACAGGAGTCCCAGACAG

CAGAACAATATTTACATGGGGGTCAGGAGGGTGAGGTTGGGTGGTCTCGGGGCTGAGTGGGCCCGCCACT

GTGGAAGAGAGGACCCTGGAGGGAGGGTGTCCTTGGACCTGTGGACCGGGCCCAAGAAGAAAAACGTCCC

ATCCTCGGCCCAGCGTGGATCCCACCACCGGGATCACCTCGGGCCCTGGAGGCTGCGCAGCGAGAAGCCA

CCGGTCAGAGCTGGGTCACCATGCCGCTGGCTTCGGAGTGAGTCTTTATGGCCTGGAAGATCCACTCCCG

GAAGTCACTGACTTTGGTGTAGACGCCTGGCTTCTGGGCCAGGGCACAGCCAGTGCCCCAACTCACAATG

CCACACAGCCGCCAACGTGGCGTCCGAGAGATGCTGTCCTCACACACAAAGGGACCACCGCTGTCGCCCT

GGCAGGCATCAATGCCACCCTCGGGGTAGCCAGCACAGAACATCTTGGGCTTGATCTGGTTTCCATAGAA

GTCAGCGCCATTGCAGACATCATTGCTGATTATGGGGACTCGAGCCTCCTGGAGTACCCCGGCCTGTTGG

CCATAGTACTGCGTGTTGCCCCAGCCCGTCACGGTACAGATCTTGCCATCCACCAGGGCCTGGCCGGCAG

CTGGGAGGCACACAGGCTGGATGTATTCTGTGAGGGGCAGGGGACTGGAGAGGTGGACCAGGGCAATATC

GTTGCTGTTCTCCTCGCTGTTGGGGTCCCGAAAGGGAAGATAGCCCCCGTGGTAGACCACAGCCTGCACC

CCCAGCTGCAGACCGTGGGGAGAGGCCTGGGCCACGGCACCGGCAAACACTCGCCATCGGGACAGGACCC

GGTTCCGCTCCGGGAAGCAGTGGGCGGCTGTCAGCACCCAGTCCCCGGAGAGCAGGGATCCCCCACAGAG

GTGTGCTCCATCATAGCGAAGGCTGACTTGCCACGGCCACCGGCCCAAGCTGGTGTCCCGGCCTCCCACG

ATGCGGTCCACGGGCAGCTTCCTGCGGCCACAGTCTTGGCAGATGGCGGCCAAGAAACGGCCTCTGGGGC

AATCACACACGGAGATGACCTCCAGCAGCCTCTGGGTGTGGGGCAGCCTCCCCTCGTCCACACAGAAGAA

GCCCGACGTGCCATTGGCGCCCGCCGTTCGCACGTCCAGCTCGGAGTGGGTCAGTGCCCTGAGGAAGCCC

ATCTCCTCGCAGCTGAGTCCGGCTACCCTGGCGTTGGAGCGCGAGGAGCACAGCAGCCGCCACGTCCCTT

CCGTCTTGTCAAAGACCATGAGCCGAGCGTCCGCAGAGCTGACCTGCACTGGGTACAGCGGCTCCTGGTC

ACTCCTGAGGAGAACAGCCACAATGGCCCAGGATGCCGCCCCGATGGCTGTCAGAAGTAGCAGGGTCCCC

GCAGTGAGAGCTGCCACCTTGGGTCTGGAGCAGCATGGCACAGTCCGGCCACCCTCCTTCTGCGCCATGT

CACTGCCTCTTGTTAATGATTCCCTGGCTGACCTCCTGGGCCAGGGTGGGACCTGTGAGGAGATGGACGG

GGAGGCAGGGCCTGGGGGAGCCCAGCCCAGCCCAGTCCTGGCGCCCCAGTCCCAGGCGTCCATCCAGGC

AGGCTGTAGGGACTGGGCCTTGGCCAGAGCACGCCGTGATCACGGACGCAGATTGGGCTGGGTTCAAGGA

TGGGGTCAGTGTCTGACCAGCAGCGGGGGACGCCTGGATTTGCAGGGATGGGGACCCCCATGCCTGAGC

CTGGTGGAGCAGGGGACTGAGGATCCCGGTTTGAGGGAGGAGACAGCTGAGGACCTGAAATCATAAGTCT

TGGGAAAGGAGGAATTTGGGGGCCAGGACTCCCTAGTATGAGGGAGGAGGGCCTGAGGGCTGGAACTCC

TGGGTCTGGGGAGGAAAGGACTGGGGTCCAACGGCTGAGTCTGAAGGAAGAGCAGGACAGAACACCTAGG

TGCTTGGGGAGACGTCATAGTGCCCCCTCTTCAGGTCCCCAGGAACCCCTCTATTAGGAGGTGGGCATTA

GGCTGGGTGGGGGATGAGGGAACCCCTGTCCTCAGGGCTGGAACTGTGAGTCTGGGGGCCCTTGTCCTT

ACCCTGGGGTCCAGCAGGTGGGGCGGAGCCTCGAGGTAGTGCCGGGGTCGGGTCAGTCTCCAGGCCTGG

GCAGGAGCATGGTGGCCCCGCAGCAGCGGGCGGCCTGGAGGCAGAGGCGGTGGCGTGGGGCCTGCTAGGC

CAGGCTGCCTCACCTGTGGGCCCTCAGGTAGGGTCCCTGGAAAGCGGGCTCGA

NOV8 is expressed in at least the following tissues: brain, Kidney, Liver, Lung, Ovary, Pancreas, Prostate, Stomach, Testis, Uterus, Whole embryo, kidney, and pancreas.

The disclosed NOV8 polypeptide (SEQ ID NO:40) encoded by SEQ ID NO:39 has 417 amino acid residues and is presented in Table 8B using the one-letter amino acid code. Signal P, Psort and/or Hydropathy results predict that NOV8 has a signal peptide and is likely to be localized to the plasma membrane with a certainty of 0.7900. In other embodiments, NOV8 may also be localized to the microbody (peroxisome) with a certainty of 0.4294, the Golgi body with a certainty of 0.3000, or the endoplasmic reticulum (membrane) with a certainty of 0.2000. The most likely cleavage site is between positions 18 and 19: SWA-IV.

TABLE 20B

Encoded NOV8 protein sequence.

MAQKEGGRTVPCCSRPKVAALTAGTLLLLTAIGAASWAIVAVLLRSDQEPLYPVQVSSAD  (SEQ ID NO:40)

ARLMVFDKTEGTWRLLCSSRSNARVAGLSCEEMGFLRALTHSELDVRTAGANGTSGFFCV

DEGRLPHTQRLLEVISVCDCPRGRFLAAICQDCGRRKLPVDRIVGGRDTSLGRWPWQVSL

RYDGAHLCGGSLLSGDWVLTAAHCFPERNRVLSRWRVFAGAVAQASPHGLQLGVQAVVYH

GGYLPFRDPNSEENSNDIALVHLSSPLPLTEYIQPVCLPAAGQALVDGKICTVTGWGNTQ

YYGQQAGVLQEARVPIISNDVCNGADFYGNQIKPKMFCAGYPEGGIDACQGDSGGPFVCE

DSISRTPRWRLCGIVSWGTGCALAQKPGVYTKVSDFREWIFQAIKTHSEASGMVTQL

NOV8 has homology to the amino acid sequence shown in the BLASTP data listed in Table 20C.

TABLE 20C

BLAST results for NOV8

| Gene Index/ Identifier | Protein/Organism | Length (aa) | Identity (%) | Positives (%) | Expect |
|---|---|---|---|---|---|
| ref\|NP_002142.1\| (NM_002151) | hepsin (transmembrane protease, serine1); hepsin [Homo sapiens] | 417 | 100 | 100 | 0.0 |
| ref\|NP_058808.1\| (NM_017112) | hepsin [Rattus norvegicus] | 416 | 88 | 91 | 0.0 |
| ref\|NP_032307.1\| (NM_008281) | hepsin [Mus musculus] | 416 | 88 | 92 | 0.0 |
| emb\|CAA30058.1\| (X07002) | hepsin [Homo sapiens] | 304 | 100 | 100 | 1e-179 |
| dbj\|BAB22289.1\| (AK002694) | putative [Mus musculus] | 502 | 73 | 77 | 1e-160 |

The homology of these sequences is shown graphically in the ClustalW analysis shown in Table 20D.

TABLE 20D

Information for the ClustalW proteins

```
1) NOV8              (SEQ ID NO:40)
2) ref|NP_002142.1|  (SEQ ID NO:136)
3) ref|NP_058808.1|  (SEQ ID NO:137)
4) ref|NP_032307.1|  (SEQ ID NO:138)
5) emb|CAA30058.1|   (SEQ ID NO:139)
6) dbj|BAB22289.1|   (SEQ ID NO:140)

10        20        30        40        50
                       ....|....|....|....|....|....|....|....|....|....|
NOV8                   --------------------------------------------------
ref|NP_002142.1|       --------------------------------------------------
ref|NP_058808.1|       --------------------------------------------------
ref|NP_032307.1|       --------------------------------------------------
emb|CAA30058.1|        --------------------------------------------------
dbj|BAB22289.1|        RPQLGRPHAAGCCCHPCLPGCPLLWGQTPCPCPGPETNPKPAPSPANPRV 60        70        80        90       100
                       ....|....|....|....|....|....|....|....|....|....|
NOV8                   ----------------MAQKE--------------------GGRTVPCCS
ref|NP_002142.1|       ----------------MAQKE--------------------GGRTVPCCS
ref|NP_058808.1|       ----------------MAKE---------------------GGRTAPCCS
ref|NP_032307.1|       ----------------MAKE---------------------GGRTAACCS
emb|CAA30058.1|        --------------------------------------------------
dbj|BAB22289.1|        PPQPNRSTWESLTRVPDMAKEDEEPGAHRGGSTCSRPQPGKGGRTAACCS
```

TABLE 20D-continued

Information for the ClustalW proteins

```
                       110       120       130       140       150
                  ....|....|....|....|....|....|....|....|....|....|
NOV8              RPKVAALTAGTLLLLTAIGAASWAIVAVLRSDQEPLYPVQVSSADARIM
ref|NP_002142.1|  RPKVAALTAGTLLLLTAIGAASWAIVAVLRSDQEPLYPVQVSSADARIM
ref|NP_058808.1|  RPKVAALTVGTLLFLTGIGAASWAIVAVLRSDQEPLYQVQLSPGDSRIL
ref|NP_032307.1|  RPKVAALIVGTLLFLTGIGAASWAIVTILIQSDQEPLYQVQLSPGDSRIA
emb|CAA30058.1|   --------------------------------------------------
dbj|BAB22289.1|   RPKVAALIVGTLLFLTGIGAASWAIVTILIQSDQEPLYQVQLSPGDSRIA 160       170       180       190       200
                  ....|....|....|....|....|....|....|....|....|....|
NOV8              VFDKTEGTWRLLCSSRSNARVAGLSCEEMGFLRAITHSELDVRTAGANGT
ref|NP_002142.1|  VFDKTEGTWRLLCSSRSNARVAGLSCEEMGFLRAITHSELDVRTAGANGT
ref|NP_058808.1|  VLDKTEGTWRLLCSSRSNARVAGLCCEEMGFLRAIAHSELDVRTAGANGT
ref|NP_032307.1|  VLDKTEGTWRLLCSSRSNARVAGLCCEEMGFLRAIAHSELDVRTAGANGT
emb|CAA30058.1|   ------------------------------------------------T
dbj|BAB22289.1|   VFDKTEGTWRLLCSSRSNARVAGLGCEEMGFLRAIAHSELDVRTAGANGT 210       220       230       240       250
                  ....|....|....|....|....|....|....|....|....|....|
NOV8              SGFFCVDEGRLPHTQRLLEVISVCDCPRGRFLAAICQDCGRRKLPVDRIV
ref|NP_002142.1|  SGFFCVDEGRLPHTQRLLEVISVCDCPRGRFLAAICQDCGRRKLPVDRIV
ref|NP_058808.1|  SGFFCVDEGGLPLAQRLLDVISVCDCPRGRFLTAICQDCGRRKLPVDRIV
ref|NP_032307.1|  SGFFCVDEGGLPLAQRLLDVISVCDCPRGRFLTAICQDCGRRKLPVDRIV
emb|CAA30058.1|   SGFFCVDEGRLPHTQRLLEVISVCDCPRGRFLAAICQDCGRRKLPVDRIV
dbj|BAB22289.1|   SGFFCVDEGGLPLAQRLLDVISVCDCPRGRFLTAICQDCGRRSCRWTALW 260       270       280       290       300
                  ....|....|....|....|....|....|....|....|....|....|
NOV8              GGRDISLGRWPWQVSLRYDGAHLCGGSLLSGDWVLTAAHCFPERNRVLSR
ref|NP_002142.1|  GGRDISLGRWPWQVSLRYDGAHLCGGSLLSGDWVLTAAHCFPERNRVLSR
ref|NP_058808.1|  GGQDSSLGRWPWQVSLRYDGTHLCGGSLLSGDWVLTAAHCFPERNRVLSR
ref|NP_032307.1|  GGQDSSLGRWPWQVSLRYDGTHLCGGSLLSGDWVLTAAHCFPERNRVLSR
emb|CAA30058.1|   GGRDISLGRWPWQVSLRYDGAHLCGGSLLSGDWVLTAAHCFPERNRVLSR
dbj|BAB22289.1|   CARTAVWEGGRGRSACVMMGRRSVGGPAVSG----LGADCCTLLSRAGDG 310       320       330       340       350
                  ....|....|....|....|....|....|....|....|....|....|
NOV8              WRVFAGAVAQASP---HGIQLGVQAVVYHGGYLPFRDPNSEENSNDIALV
ref|NP_002142.1|  WRVFAGAVAQASP---HGIQLGVQAVVYHGGYLPFRDPNSEENSNDIALV
ref|NP_058808.1|  WRVFAGAVARTSP---HAVQLGVQAVIYHGGYLPFRDPTIDENSNDIALV
ref|NP_032307.1|  WRVFAGAVARTSP---HAVQLGVQAVIYHGGYLPFRDPTIDENSNDIALV
emb|CAA30058.1|   WRVFAGAVAQASP---HGIQLGVQAVVYHGGYLPFRDPNSEENSNDIALV
dbj|BAB22289.1|   PVSVASICWCCSPDLTPCCATGVQAVIYHGGYLLFRDPTIDENSNDIALV 360       370       380       390       400
                  ....|....|....|....|....|....|....|....|....|....|
NOV8              HLSSPLPLTEYIQPVCLPAAGQALVDGKICTVTGWGNTQIYGQQAGVLQE
ref|NP_002142.1|  HLSSPLPLTEYIQPVCLPAAGQALVDGKICTVTGWGNTQIYGQQAGVLQE
ref|NP_058808.1|  HLSSSLPLTEYIQPVCLPAAGQALVDGKVCTVTGWGNTQIYGQQAVVLQE
ref|NP_032307.1|  HLSSSLPLTEYIQPVCLPAAGQALVDGKVCTVTGWGNTQIYGQQAMVLQE
emb|CAA30058.1|   HLSSPLPLTEYIQPVCLPAAGQALVDGKICTVTGWGNTQIYGQQAGVLQE
dbj|BAB22289.1|   NLSSSLPLTEYIQPVCLPAAGQALVDGKVCTVTGWGNTQIYGQQAMVLQE 410       420       430       440       450
                  ....|....|....|....|....|....|....|....|....|....|
NOV8              ARVPIISNDVCNGADFYGNQIKPKMFCAGYPEGGIDACQGDSGGPFVCED
ref|NP_002142.1|  ARVPIISNDVCNGADFYGNQIKPKMFCAGYPEGGIDACQGDSGGPFVCED
ref|NP_058808.1|  ARVPIISNEVCNSPDFYGNQIKPKMFCAGYPEGGIDACQGDSGGHFVCED
ref|NP_032307.1|  ARVPIISNEVCNSPDFYGNQIKPKMFCAGYPEGGIDACQGDSGGPFVCED
emb|CAA30058.1|   ARVPIISNDVCNGADFYGNQIKPKMFCAGYPEGGIDACQGDSGGPFVCED
dbj|BAB22289.1|   ARVPIISNEVCNSPDFYGNQIKPKMFCAGYPEGGIDACQGDSGGPFVCED 460       470       480       490       500
                  ....|....|....|....|....|....|....|....|....|....|
NOV8              SISRTPRWRLCGIVSWGTGCALAQKPGVYTKVSDFREWIFQAIKTHSEAS
ref|NP_002142.1|  SISRTPRWRLCGIVSWGTGCALAQKPGVYTKVSDFREWIFQAIKTHSEAS
ref|NP_058808.1|  RISGTSRWRLCGIVSWGTGCALARKPGVYTKVIDFREWIFQAIKTHSEAT
ref|NP_032307.1|  SISGTSRWRLCGIVSWGTGCALARKPGVYTKVIDFREWIFRAIKTHSEAS
emb|CAA30058.1|   SISRTPRWRLCGIVSWGTGCALAQKPGVYTKVSDFREWIFQAIKTHSEAS
dbj|BAB22289.1|   SISGTSRWRLCGIVSWGTGCALARKPGVYTKVIDFREWIFRAIKTHSEAS ....|.
NOV8              GMVTQL
ref|NP_002142.1|  GMVTQL
ref|NP_058808.1|  GMVTQP
ref|NP_032307.1|  GMVTQP
emb|CAA30058.1|   GMVTQL
dbj|BAB22289.1|   GMVTQP
```

Tables 20E lists the domain description from DOMAIN analysis results against NOV8. This indicates that the NOV8 sequence has properties similar to those of other proteins known to contain this domain.

TABLE 20E

Domain Analysis of NOV8 gnl|Smart|smart00020, Tryp_SPc, Trypsin-like serine protease
CD-Length = 230 residues, 100.0% aligned Score = 261 bits (668), Expect = 4e−71

Hepsin is a type II transmembrane serine protease abundantly expressed on the surface of hepatocytes. Biochemical studies have shown that hepsin is an enzyme of 51 kDa with the trypsin-like substrate specificity. Several in vitro studies have suggested that hepsin may play a role in blood coagulation, hepatocyte growth, and fertilization. To determine the functional importance of hepsin, hepsin-deficient mice were generated by homologous recombination. Homozygous hepsin−/− mice were viable and fertile, and grew normally. When analyzed in hemostasis assays, such as tail bleeding time and plasma clotting times, and in vivo modes, such as disseminated intravascular coagulation, septic shock, and acute liver regeneration, hepsin−/− mice had similar phenotypes as wild-type controls. Liver weight and serum concentrations of liver-derived proteins or enzymes were also similar in hepsin−/− and wild-type mice. No abnormalities were identified in major organs in hepsin−/− mice in histological examinations. These results indicate that hepsin is not an essential enzyme for normal hemostasis, embryogenesis, and maintenance of normal liver function. Unexpectedly, serum concentrations of bone-derived alkaline phosphatase were approximately two-fold higher in both male and female hepsin−/− mice than those in wild-type controls. The underlying mechanism for this phenotype and long-term effects of hepsin deficiency remain to be determined. (See Wu, 2001, Front Biosci 1;6:D192–200).

The disclosed NOV8 nucleic acid of the invention encoding a hepsin-like protein includes the nucleic acid whose sequence is provided in Table 20A, or a fragment thereof. The invention also includes a mutant or variant nucleic acid any of whose bases may be changed from the corresponding base shown in Table 20A while still encoding a protein that maintains its hepsin-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 0 percent of the bases may be so changed.

The disclosed NOV8 protein of the invention includes the hepsin-like protein whose sequence is provided in Table 20B. The invention also includes a mutant or variant protein any of whose residues may be changed from the corresponding residue shown in Table 2 while still encoding a protein that maintains its hepsin-like activities and physiological functions, or a functional fragment thereof. In the mutant or variant protein, up to about 0 percent of the residues may be so changed.

The invention further encompasses antibodies and antibody fragments, such as $F_{ab}$ or $(F_{ab})_2$, that bind immunospecifically to any of the proteins of the invention.

The above defined information for this invention suggests that this hepsin-like protein (NOV8) may function as a member of a "RNase family". Therefore, the NOV8 nucleic acids and proteins identified here may be useful in potential therapeutic applications implicated in (but not limited to) various pathologies and disorders as indicated below. The potential therapeutic applications for this invention include, but are not limited to: protein therapeutic, small molecule drug target, antibody target (therapeutic, diagnostic, drug targeting/cytotoxic antibody), diagnostic and/or prognostic marker, gene therapy (gene delivery/gene ablation), research tools, tissue regeneration in vivo and in vitro of all tissues and cell types composing (but not limited to) those defined here.

The NOV8 nucleic acids and proteins of the invention are useful in potential therapeutic applications implicated in cancer, especially prostate and ovarian cancer, and/or other pathologies/disorders.

NOV8 nucleic acids and polypeptides are further useful in the generation of antibodies that bind immuno-specifically to the novel NOV8 substances for use in therapeutic or diagnostic methods. These antibodies may be generated according to methods known in the art, using prediction from hydrophobicity charts, as described in the "Anti-NOVX Antibodies" section below. The disclosed NOV8 protein has multiple hydrophilic regions, each of which can be used as an immunogen. These novel proteins can be used in assay systems for functional analysis of various human disorders, which will help in understanding of pathology of the disease and development of new drug targets for various disorders.

SECX and/or NOVX Nucleic Acids and Polypeptides

One aspect of the invention pertains to isolated nucleic acid molecules that encode SECX and/or NOVX polypeptides or biologically active portions thereof. Also included in the invention are nucleic acid fragments sufficient for use as hybridization probes to identify SECX and/or NOVX-encoding nucleic acids (e.g., SECX and/or NOVX mRNAs) and fragments for use as PCR primers for the amplification and/or mutation of SECX and/or NOVX nucleic acid molecules. As used herein, the term "nucleic acid molecule" is intended to include DNA molecules (e.g., cDNA or genomic DNA), RNA molecules (e.g., mRNA), analogs of the DNA or RNA generated using nucleotide analogs, and derivatives, fragments and homologs thereof. The nucleic acid molecule may be single-stranded or double-stranded, but preferably is comprised double-stranded DNA.

An SECX and/or NOVX nucleic acid can encode a mature SECX and/or NOVX polypeptide. As used herein, a "mature" form of a polypeptide or protein disclosed in the present invention is the product of a naturally occurring polypeptide or precursor form or proprotein. The naturally occurring polypeptide, precursor or proprotein includes, by way of nonlimiting example, the full-length gene product, encoded by the corresponding gene. Alternatively, it may be defined as the polypeptide, precursor or proprotein encoded by an ORF described herein. The product "mature" form arises, again by way of nonlimiting example, as a result of one or more naturally occurring processing steps as they may take place within the cell, or host cell, in which the gene product arises. Examples of such processing steps leading to a "mature" form of a polypeptide or protein include the cleavage of the N-terminal methionine residue encoded by the initiation codon of an ORF, or the proteolytic cleavage of a signal peptide or leader sequence. Thus a mature form arising from a precursor polypeptide or protein that has residues 1 to N, where residue 1 is the N-terminal methionine, would have residues 2 through N remaining after removal of the N-terminal methionine. Alternatively, a mature form arising from a precursor polypeptide or protein having residues 1 to N, in which an N-terminal signal sequence from residue 1 to residue M is cleaved, would have the residues from residue M+1 to residue N remaining. Further as used herein, a "mature" form of a polypeptide or protein may arise from a step of post-translational modification other than a proteolytic cleavage event. Such additional processes include, by way of non-limiting example, glycosylation, myristoylation or phosphorylation. In general, a mature polypeptide or protein may result from the operation of only one of these processes, or a combination of any of them.

The term "probes", as utilized herein, refers to nucleic acid sequences of variable length, preferably between at least about 10 nucleotides (nt), 100 nt, or as many as approximately, e.g., 6,000 nt, depending upon the specific use. Probes are used in the detection of identical, similar, or complementary nucleic acid sequences. Longer length probes are generally obtained from a natural or recombinant source, are highly specific, and much slower to hybridize than shorter-length oligomer probes. Probes may be single- or double-stranded and designed to have specificity in PCR, membrane-based hybridization technologies, or ELISA-like technologies.

The term "isolated" nucleic acid molecule, as utilized herein, is one, which is separated from other nucleic acid molecules which are present in the natural source of the nucleic acid. Preferably, an "isolated" nucleic acid is free of sequences which naturally flank the nucleic acid (i.e., sequences located at the 5'- and 3'-termini of the nucleic acid) in the genomic DNA of the organism from which the nucleic acid is derived. For example, in various embodiments, the isolated SECX and/or NOVX nucleic acid molecules can contain less than about 5 kb, 4 kb, 3 kb, 2 kb, 1 kb, 0.5 kb or 0.1 kb of nucleotide sequences which naturally flank the nucleic acid molecule in genomic DNA of the cell/tissue from which the nucleic acid is derived (e.g., brain, heart, liver, spleen, etc.). Moreover, an "isolated" nucleic acid molecule, such as a cDNA molecule, can be substantially free of other cellular material or culture medium when produced by recombinant techniques, or of chemical precursors or other chemicals when chemically synthesized.

A nucleic acid molecule of the invention, e.g., a nucleic acid molecule having the nucleotide sequence SEQ ID NOS:1, 3, 5, 7, 9, 11, 13, 15, 17, 19, 21, 23, 25, 27, 29, 31, 33, 35, 37, 39 and 319, or a complement of this aforementioned nucleotide sequence, can be isolated using standard molecular biology techniques and the sequence information provided herein. Using all or a portion of the nucleic acid sequence of SEQ ID NOS:1, 3, 5, 7, 9, 11, 13, 15, 17, 19, 21, 23, 25, 27, 29, 31, 33, 35, 37, 39 and 319 as a hybridization probe, SECX and/or NOVX molecules can be isolated using standard hybridization and cloning techniques (e.g., as described in Sambrook, et al., (eds.), MOLECULAR CLONING: A LABORATORY MANUAL 2$^{nd}$ Ed., Cold Spring Harbor Laboratory Press, Cold Spring Harbor, N.Y., 1989; and Ausubel, et al., (eds.), CURRENT PROTOCOLS IN MOLECULAR BIOLOGY, John Wiley & Sons, New York, N.Y., 1993.)

A nucleic acid of the invention can be amplified using cDNA, mRNA or alternatively, genomic DNA, as a template and appropriate oligonucleotide primers according to standard PCR amplification techniques. The nucleic acid so amplified can be cloned into an appropriate vector and characterized by DNA sequence analysis. Furthermore, oligonucleotides corresponding to SECX and/or NOVX nucleotide sequences can be prepared by standard synthetic techniques, e.g., using an automated DNA synthesizer.

As used herein, the term "oligonucleotide" refers to a series of linked nucleotide residues, which oligonucleotide has a sufficient number of nucleotide bases to be used in a PCR reaction. A short oligonucleotide sequence may be based on, or designed from, a genomic or cDNA sequence and is used to amplify, confirm, or reveal the presence of an identical, similar or complementary DNA or RNA in a particular cell or tissue. Oligonucleotides comprise portions of a nucleic acid sequence having about 10 nt, 50 nt, or 100 nt in length, preferably about 15 nt to 30 nt in length. In one embodiment of the invention, an oligonucleotide comprising a nucleic acid molecule less than 100 nt in length would further comprise at least 6 contiguous nucleotides SEQ ID NOS:1, 3, 5, 7, 9, 11, 13, 15, 17, 19, 21, 23, 25, 27, 29, 31, 33, 35, 37, 39 and 319, or a complement thereof. Oligonucleotides may be chemically synthesized and may also be used as probes.

In another embodiment, an isolated nucleic acid molecule of the invention comprises a nucleic acid molecule that is a complement of the nucleotide sequence shown in SEQ ID NOS:1, 3, 5, 7, 9, 11, 13, 15, 17, 19, 21, 23, 25, 27, 29, 31, 33, 35, 37, 39 and 319, or a portion of this nucleotide sequence (e.g., a fragment that can be used as a probe or primer or a fragment encoding a biologically-active portion of an SECX and/or NOVX polypeptide). A nucleic acid molecule that is complementary to the nucleotide sequence shown SEQ ID NOS:1, 3, 5, 7, 9, 11, 13, 15, 17, 19, 21, 23, 25, 27, 29, 31, 33, 35, 37, 39 or 319 is one that is sufficiently complementary to the nucleotide sequence shown SEQ ID NOS:1, 3, 5, 7, 9, 11, 13, 15, 17, 19, 21, 23, 25, 27, 29, 31, 33, 35, 37, 39 or 319 that it can hydrogen bond with little or no mismatches to the nucleotide sequence shown SEQ ID NOS:1, 3, 5, 7, 9, 11, 13, 15, 17, 19, 21, 23, 25, 27, 29, 31, 33, 35, 37, 39 and 319, thereby forming a stable duplex.

As used herein, the term "complementary" refers to Watson-Crick or Hoogsteen base pairing between nucleotides units of a nucleic acid molecule, and the term "binding" means the physical or chemical interaction between two polypeptides or compounds or associated polypeptides or compounds or combinations thereof. Binding includes ionic, non-ionic, van der Waals, hydrophobic interactions, and the like. A physical interaction can be either direct or indirect. Indirect interactions may be through or due to the effects of another polypeptide or compound. Direct binding refers to interactions that do not take place through, or due to, the effect of another polypeptide or compound, but instead are without other substantial chemical intermediates.

Fragments provided herein are defined as sequences of at least 6 (contiguous) nucleic acids or at least 4 (contiguous) amino acids, a length sufficient to allow for specific hybridization in the case of nucleic acids or for specific recognition of an epitope in the case of amino acids, respectively, and are at most some portion less than a full length sequence. Fragments may be derived from any contiguous portion of a nucleic acid or amino acid sequence of choice. Derivatives are nucleic acid sequences or amino acid sequences formed from the native compounds either directly or by modification or partial substitution. Analogs are nucleic acid sequences or amino acid sequences that have a structure similar to, but not identical to, the native compound but differs from it in respect to certain components or side chains. Analogs may be synthetic or from a different evolutionary origin and may have a similar or opposite metabolic activity compared to wild type. Homologs are nucleic acid sequences or amino acid sequences of a particular gene that are derived from different species.

Derivatives and analogs may be full length or other than full length, if the derivative or analog contains a modified nucleic acid or amino acid, as described below. Derivatives or analogs of the nucleic acids or proteins of the invention include, but are not limited to, molecules comprising regions that are substantially homologous to the nucleic acids or proteins of the invention, in various embodiments, by at least about 70%, 80%, or 95% identity (with a preferred identity of 80–95%) over a nucleic acid or amino acid sequence of identical size or when compared to an aligned sequence in which the alignment is done by a computer homology program known in the art, or whose encoding nucleic acid is capable of hybridizing to the complement of a sequence encoding the aforementioned proteins under stringent, moderately stringent, or low stringent conditions. See e.g. Ausubel, et al., CURRENT PROTOCOLS IN MOLECULAR BIOLOGY, John Wiley & Sons, New York, N.Y., 1993, and below.

A "homologous nucleic acid sequence" or "homologous amino acid sequence," or variations thereof, refer to sequences characterized by a homology at the nucleotide level or amino acid level as discussed above. Homologous nucleotide sequences encode those sequences coding for isoforms of SECX and/or NOVX polypeptides. Isoforms can be expressed in different tissues of the same organism as a result of, for example, alternative splicing of RNA. Alternatively, isoforms can be encoded by different genes. In the invention, homologous nucleotide sequences include nucleotide sequences encoding for an SECX and/or NOVX polypeptide of species other than humans, including, but not limited to: vertebrates, and thus can include, e.g., frog, mouse, rat, rabbit, dog, cat cow, horse, and other organisms. Homologous nucleotide sequences also include, but are not limited to, naturally occurring allelic variations and mutations of the nucleotide sequences set forth herein. A homologous nucleotide sequence does not, however, include the exact nucleotide sequence encoding human SECX and/or NOVX protein. Homologous nucleic acid sequences include those nucleic acid sequences that encode conservative amino acid substitutions (see below) in SEQ ID NOS:1, 3, 5, 7, 9, 11, 13, 15, 17, 19, 21, 23, 25, 27, 29, 31, 33, 35, 37, 39 and 319, as well as a polypeptide possessing SECX and/or NOVX biological activity. Various biological activities of the SECX and/or NOVX proteins are described below.

An SECX and/or NOVX polypeptide is encoded by the open reading frame ("ORF") of an SECX and/or NOVX nucleic acid. An ORF corresponds to a nucleotide sequence that could potentially be translated into a polypeptide. A stretch of nucleic acids comprising an ORF is uninterrupted by a stop codon. An ORF that represents the coding sequence for a full protein begins with an ATG "start" codon and terminates with one of the three "stop" codons, namely, TAA, TAG, or TGA. For the purposes of this invention, an ORF may be any part of a coding sequence, with or without a start codon, a stop codon, or both. For an ORF to be considered as a good candidate for coding for a bonafide cellular protein, a minimum size requirement is often set, e.g., a stretch of DNA that would encode a protein of 50 amino acids or more.

The nucleotide sequences determined from the cloning of the human SECX and/or NOVX genes allows for the generation of probes and primers designed for use in identifying and/or cloning SECX and/or NOVX homologues in other cell types, e.g. from other tissues, as well as SECX and/or NOVX homologues from other vertebrates. The probe/primer typically comprises substantially purified oligonucleotide. The oligonucleotide typically comprises a region of nucleotide sequence that hybridizes under stringent conditions to at least about 12, 25, 50, 100, 150, 200, 250, 300, 350 or 400 consecutive sense strand nucleotide sequence SEQ ID NOS:1, 3, 5, 7, 9, 11, 13, 15, 17, 19, 21, 23, 25, 27, 29, 31, 33, 35, 37, 39 or 319; or an anti-sense strand nucleotide sequence of SEQ ID NOS:1, 3, 5, 7, 9, 11, 13, 15, 17, 19, 21, 23, 25, 27, 29, 31, 33, 35, 37, 39 or 319; or of a naturally occurring mutant of SEQ ID NOS:1, 3, 5, 7, 9, 11, 13, 15, 17, 19, 21, 23, 25, 27, 29, 31, 33, 35, 37, 39 and 319.

Probes based on the human SECX and/or NOVX nucleotide sequences can be used to detect transcripts or genomic sequences encoding the same or homologous proteins. In various embodiments, the probe further comprises a label group attached thereto, e.g. the label group can be a radioisotope, a fluorescent compound, an enzyme, or an enzyme co-factor. Such probes can be used as a part of a diagnostic test kit for identifying cells or tissues which mis-express an SECX and/or NOVX protein, such as by measuring a level of an SECX and/or NOVX-encoding nucleic acid in a sample of cells from a subject e.g., detecting SECX and/or NOVX mRNA levels or determining whether a genomic SECX and/or NOVX gene has been mutated or deleted.

"A polypeptide having a biologically-active portion of an SECX and/or NOVX polypeptide" refers to polypeptides exhibiting activity similar, but not necessarily identical to, an activity of a polypeptide of the invention, including mature forms, as measured in a particular biological assay, with or without dose dependency. A nucleic acid fragment encoding a "biologically-active portion of SECX and/or NOVX" can be prepared by isolating a portion SEQ ID NOS:1, 3, 5, 7, 9, 11, 13, 15, 17, 19, 21, 23, 25, 27, 29, 31, 33, 35, 37, 39 or 319, that encodes a polypeptide having an SECX and/or NOVX biological activity (the biological activities of the SECX and/or NOVX proteins are described below), expressing the encoded portion of SECX and/or NOVX protein (e.g., by recombinant expression in vitro) and assessing the activity of the encoded portion of SECX and/or NOVX.

SECX and/or NOVX Nucleic Acid and Polypeptide Variants

The invention further encompasses nucleic acid molecules that differ from the nucleotide sequences shown in SEQ ID NOS:1, 3, 5, 7, 9, 11, 13, 15, 17, 19, 21, 23, 25, 27, 29, 31, 33, 35, 37, 39 and 319 due to degeneracy of the genetic code and thus encode the same SECX and/or NOVX proteins as that encoded by the nucleotide sequences shown in SEQ ID NOS:1, 3, 5, 7, 9, 11, 13, 15, 17, 19, 21, 23, 25, 27, 29, 31, 33, 35, 37, 39 and 319. In another embodiment, an isolated nucleic acid molecule of the invention has a nucleotide sequence encoding a protein having an amino acid sequence shown in SEQ ID NOS:2, 4, 6, 8, 10, 12, 14, 16, 18, 20, 22, 24, 26, 28, 30, 32, 34, 36, 38, 40 or 320.

In addition to the human SECX and/or NOVX nucleotide sequences shown in SEQ ID NOS:1, 3, 5, 7, 9, 11, 13, 15, 17, 19, 21, 23, 25, 27, 29, 31, 33, 35, 37, 39 and 319, it will be appreciated by those skilled in the art that DNA sequence polymorphisms that lead to changes in the amino acid sequences of the SECX and/or NOVX polypeptides may exist within a population (e.g., the human population). Such genetic polymorphism in the SECX and/or NOVX genes may exist among individuals within a population due to natural allelic variation. As used herein, the terms "gene" and "recombinant gene" refer to nucleic acid molecules comprising an open reading frame (ORF) encoding an SECX and/or NOVX protein, preferably a vertebrate SECX and/or NOVX protein. Such natural allelic variations can typically result in 1–5% variance in the nucleotide sequence of the SECX and/or NOVX genes. Any and all such nucleotide variations and resulting amino acid polymorphisms in the SECX and/or NOVX polypeptides, which are the result of natural allelic variation and that do not alter the functional activity of the SECX and/or NOVX polypeptides, are intended to be within the scope of the invention.

Moreover, nucleic acid molecules encoding SECX and/or NOVX proteins from other species, and thus that have a nucleotide sequence that differs from the human SEQ ID NOS:1, 3, 5, 7, 9, 11, 13, 15, 17, 19, 21, 23, 25, 27, 29, 31, 33, 35, 37, 39 and 319 are intended to be within the scope of the invention. Nucleic acid molecules corresponding to natural allelic variants and homologues of the SECX and/or NOVX cDNAs of the invention can be isolated based on their homology to the human SECX and/or NOVX nucleic acids disclosed herein using the human cDNAs, or a portion thereof, as a hybridization probe according to standard hybridization techniques under stringent hybridization conditions.

Accordingly, in another embodiment, an isolated nucleic acid molecule of the invention is at least 6 nucleotides in length and hybridizes under stringent conditions to the nucleic acid molecule comprising the nucleotide sequence of SEQ ID NOS:1, 3, 5, 7, 9, 11, 13, 15, 17, 19, 21, 23, 25, 27, 29, 31, 33, 35, 37, 39 and 319. In another embodiment, the nucleic acid is at least 10, 25, 50, 100, 250, 500, 750, 1000, 1500, or 2000 or more nucleotides in length. In yet another embodiment, an isolated nucleic acid molecule of the invention hybridizes to the coding region. As used herein, the term "hybridizes under stringent conditions" is intended to describe conditions for hybridization and washing under which nucleotide sequences at least 60% homologous to each other typically remain hybridized to each other.

Homologs (i.e., nucleic acids encoding SECX and/or NOVX proteins derived from species other than human) or other related sequences (e.g., paralogs) can be obtained by low, moderate or high stringency hybridization with all or a portion of the particular human sequence as a probe using methods well known in the art for nucleic acid hybridization and cloning.

As used herein, the phrase "stringent hybridization conditions" refers to conditions under which a probe, primer or oligonucleotide will hybridize to its target sequence, but to no other sequences. Stringent conditions are sequence-dependent and will be different in different circumstances. Longer sequences hybridize specifically at higher temperatures than shorter sequences. Generally, stringent conditions are selected to be about 5° C. lower than the thermal melting point (Tm) for the specific sequence at a defined ionic strength and pH. The Tm is the temperature (under defined ionic strength, pH and nucleic acid concentration) at which 50% of the probes complementary to the target sequence hybridize to the target sequence at equilibrium. Since the target sequences are generally present at excess, at Tm, 50% of the probes are occupied at equilibrium. Typically, stringent conditions will be those in which the salt concentration is less than about 1.0 M sodium ion, typically about 0.01 to 1.0 M sodium ion (or other salts) at pH 7.0 to 8.3 and the temperature is at least about 30° C. for short probes, primers or oligonucleotides (e.g., 10 nt to 50 nt) and at least about 60° C. for longer probes, primers and oligonucleotides. Stringent conditions may also be achieved with the addition of destabilizing agents, such as formamide.

Stringent conditions are known to those skilled in the art and can be found in Ausubel, et al., (eds.), CURRENT PROTOCOLS IN MOLECULAR BIOLOGY, John Wiley & Sons, N.Y. (1989), 6.3.1–6.3.6. Preferably, the conditions are such that sequences at least about 65%, 70%, 75%, 85%, 90%, 95%, 98%, or 99% homologous to each other typically remain hybridized to each other. A non-limiting example of stringent hybridization conditions are hybridization in a high salt buffer comprising 6×SSC, 50 mM Tris-HCl (pH 7.5), 1 mM EDTA, 0.02% PVP, 0.02% Ficoll, 0.02% BSA, and 500 mg/ml denatured salmon sperm DNA at 65° C., followed by one or more washes in 0.2×SSC, 0.01% BSA at 50° C. An isolated nucleic acid molecule of the invention that hybridizes under stringent conditions to the sequences SEQ ID NOS:1, 3, 5, 7, 9, 11, 13, 15, 17, 19, 21, 23, 25, 27, 29, 31, 33, 35, 37, 39 and 319, corresponds to a naturally-occurring nucleic acid molecule. As used herein, a "naturally-occurring" nucleic acid molecule refers to an RNA or DNA molecule having a nucleotide sequence that occurs in nature (e.g., encodes a natural protein).

In a second embodiment, a nucleic acid sequence that is hybridizable to the nucleic acid molecule comprising the nucleotide sequence of SEQ ID NOS:1, 3, 5, 7, 9, 11, 13, 15, 17, 19, 21, 23, 25, 27, 29, 31, 33, 35, 37, 39 and 319, or fragments, analogs or derivatives thereof, under conditions of moderate stringency is provided. A non-limiting example of moderate stringency hybridization conditions are hybridization in 6×SSC, 5× Denhardt's solution, 0.5% SDS and 100 mg/ml denatured salmon sperm DNA at 55° C., followed by one or more washes in 1× SSC, 0.1% SDS at 37° C. Other conditions of moderate stringency that may be used are well-known within the art. See, e.g., Ausubel, et al. (eds.), 1993, CURRENT PROTOCOLS IN MOLECULAR BIOLOGY, John Wiley & Sons, NY, and Kriegler, 1990; GENE TRANSFER AND EXPRESSION, A LABORATORY MANUAL, Stockton Press, NY.

In a third embodiment, a nucleic acid that is hybridizable to the nucleic acid molecule comprising the nucleotide sequences SEQ ID NOS:1, 3, 5, 7, 9, 11, 13, 15, 17, 19, 21, 23, 25, 27, 29, 31, 33, 35, 37, 39 and 319, or fragments, analogs or derivatives thereof, under conditions of low stringency, is provided. A non-limiting example of low stringency hybridization conditions are hybridization in 35% formamide, 5× SSC, 50 mM Tris-HCl (pH 7.5), 5 mM EDTA, 0.02% PVP, 0.02% Ficoll, 0.2% BSA, 100 mg/ml denatured salmon sperm DNA, 10% (wt/vol) dextran sulfate at 40° C., followed by one or more washes in 2× SSC, 25 mM Tris-HCl (pH 7.4), 5 mM EDTA, and 0.1% SDS at 50° C. Other conditions of low stringency that may be used are well known in the art (e.g., as employed for cross-species hybridizations). See, e.g., Ausubel, et al. (eds.), 1993, CURRENT PROTOCOLS IN MOLECULAR BIOLOGY, John Wiley & Sons, NY, and Kriegler, 1990, GENE TRANSFER AND EXPRESSION, A LABORATORY MANUAL, Stockton Press, NY; Shilo and Weinberg, 1981. *Proc Natl Acad Sci USA* 78: 6789–6792.

Conservative Mutations

In addition to naturally-occurring allelic variants of SECX and/or NOVX sequences that may exist in the population, the skilled artisan will further appreciate that changes can be introduced by mutation into the nucleotide sequences SEQ ID NOS:1, 3, 5, 7, 9, 11, 13, 15, 17, 19, 21, 23, 25, 27, 29, 31, 33, 35, 37, 39 and 319, thereby leading to changes in the amino acid sequences of the encoded SECX and/or NOVX proteins, without altering the functional ability of said SECX and/or NOVX proteins. For example, nucleotide substitutions leading to amino acid substitutions at "non-essential" amino acid residues can be made in the sequence SEQ ID NOS:2, 4, 6, 8, 10, 12, 14, 16, 18, 20, 22, 24, 26, 28, 30, 32, 34, 36, 38, 40 or 320. A "non-essential" amino acid residue is a residue that can be altered from the wild-type sequences of the SECX and/or NOVX proteins without altering their biological activity, whereas an "essential" amino acid residue is required for such biological activity. For example, amino acid residues that are conserved among the SECX and/or NOVX proteins of the invention are predicted to be particularly non-amenable to alteration. Amino acids for which conservative substitutions can be made are well-known within the art.

Another aspect of the invention pertains to nucleic acid molecules encoding SECX and/or NOVX proteins that contain changes in amino acid residues that are not essential for activity. Such SECX and/or NOVX proteins differ in amino acid sequence from SEQ ID NOS:1, 3, 5, 7, 9, 11, 13, 15, 17, 19, 21, 23, 25, 27, 29, 31, 33, 35, 37, 39 and 319 yet retain biological activity. In one embodiment, the isolated nucleic acid molecule comprises a nucleotide sequence encoding a protein, wherein the protein comprises an amino acid sequence at least about 45% homologous to the amino acid sequences SEQ ID NOS:2, 4, 6, 8, 10, 12, 14, 16, 18, 20, 22, 24, 26, 28, 30, 32, 34, 36, 38, 40 and 320. Preferably, the protein encoded by the nucleic acid molecule is at least about 60% homologous to SEQ ID NOS:2, 4, 6, 8, 10, 12, 14, 16, 18, 20, 22, 24, 26, 28, 30, 32, 34, 36, 38, 40 and 320; more preferably at least about 70% homologous SEQ ID NOS:2, 4, 6, 8, 10, 12, 14, 16, 18, 20, 22, 24, 26, 28, 30, 32, 34, 36, 38, 40 or 320; still more preferably at least about 80% homologous to SEQ ID NOS:2, 4, 6, 8, 10, 12, 14, 16, 18, 20, 22, 24, 26, 28, 30, 32, 34, 36, 38, 40 or 320; even more preferably at least about 90% homologous to SEQ ID NOS:2, 4, 6, 8, 10, 12, 14, 16, 18, 20, 22, 24, 26, 28, 30, 32, 34, 36, 38, 40 or 320; and most preferably at least about 95% homologous to SEQ ID NOS:2, 4, 6, 8, 10, 12, 14, 16, 18, 20, 22, 24, 26, 28, 30, 32, 34, 36, 38, 40 or 320.

An isolated nucleic acid molecule encoding an SECX and/or NOVX protein homologous to the protein of SEQ ID NOS:2, 4, 6, 8, 10, 12, 14, 16, 18, 20, 22, 24, 26, 28, 30, 32, 34, 36, 38, 40 or 320 can be created by introducing one or more nucleotide substitutions, additions or deletions into the nucleotide sequence of SEQ ID NOS:1, 3, 5, 7, 9, 11, 13, 15, 17, 19, 21, 23, 25, 27, 29, 31, 33, 35, 37, 39 and 319, such that one or more amino acid substitutions, additions or deletions are introduced into the encoded protein.

Mutations can be introduced into SEQ ID NOS:1, 3, 5, 7, 9, 11, 13, 15, 17, 19, 21, 23, 25, 27, 29, 31, 33, 35, 37, 39 and 319 by standard techniques, such as site-directed mutagenesis and PCR-mediated mutagenesis. Preferably, conservative amino acid substitutions are made at one or more predicted, non-essential amino acid residues. A "conservative amino acid substitution" is one in which the amino acid residue is replaced with an amino acid residue having a similar side chain. Families of amino acid residues having similar side chains have been defined within the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Thus, a predicted non-essential amino acid residue in the SECX and/or NOVX protein is replaced with another amino acid residue from the same side chain family. Alternatively, in another embodiment, mutations can be introduced randomly along all or part of an SECX and/or NOVX coding sequence, such as by saturation mutagenesis, and the resultant mutants can be screened for SECX and/or NOVX biological activity to identify mutants that retain activity. Following mutagenesis SEQ ID NOS:1, 3, 5, 7, 9, 11, 13, 15, 17, 19, 21, 23, 25, 27, 29, 31, 33, 35, 37, 39 and 319, the encoded protein can be expressed by any recombinant technology known in the art and the activity of the protein can be determined.

The relatedness of amino acid families may also be determined based on side chain interactions. Substituted amino acids may be fully conserved "strong" residues or fully conserved "weak" residues. The "strong" group of conserved amino acid residues may be any one of the following groups: STA, NEQK, NHQK, NDEQ, QHRK, MILV, MILF, HY, FYW, wherein the single letter amino acid codes are grouped by those amino acids that may be substituted for each other. Likewise, the "weak" group of conserved residues may be any one of the following: CSA, ATV, SAG, STNK, STPA, SGND, SNDEQK, NDEQHK, NEQHRK, VLIM, HFY, wherein the letters within each group represent the single letter amino acid code.

In one embodiment, a mutant SECX and/or NOVX protein can be assayed for (i) the ability to form protein:protein interactions with other SECX and/or NOVX proteins, other cell-surface proteins, or biologically-active portions thereof, (ii) complex formation between a mutant SECX and/or NOVX protein and an SECX and/or NOVX ligand; or (iii) the ability of a mutant SECX and/or NOVX protein to bind to an intracellular target protein or biologically-active portion thereof; (e.g. avidin proteins).

In yet another embodiment, a mutant SECX and/or NOVX protein can be assayed for the ability to regulate a specific biological function (e.g., regulation of insulin release).

Antisense Nucleic Acids

Another aspect of the invention pertains to isolated antisense nucleic acid molecules that are hybridizable to or complementary to the nucleic acid molecule comprising the nucleotide sequence of SEQ ID NOS:1, 3, 5, 7, 9, 11, 13, 15, 17, 19, 21, 23, 25, 27, 29, 31, 33, 35, 37, 39 and 319, or fragments, analogs or derivatives thereof. An "antisense" nucleic acid comprises a nucleotide sequence that is complementary to a "sense" nucleic acid encoding a protein (e.g., complementary to the coding strand of a double-stranded cDNA molecule or complementary to an mRNA sequence). In specific aspects, antisense nucleic acid molecules are provided that comprise a sequence complementary to at least about 10, 25, 50, 100, 250 or 500 nucleotides or an entire SECX and/or NOVX coding strand, or to only a portion thereof. Nucleic acid molecules encoding fragments, homologs, derivatives and analogs of an SECX and/or NOVX protein of SEQ ID NOS:2, 4, 6, 8, 10, 12, 14, 16, 18, 20, 22, 24, 26, 28, 30, 32, 34, 36, 38, 40 or 320, or antisense nucleic acids complementary to an SECX and/or NOVX nucleic acid sequence of SEQ ID NOS:1, 3, 5, 7, 9, 11, 13, 15, 17, 19, 21, 23, 25, 27, 29, 31, 33, 35, 37, 39 and 319, are additionally provided.

In one embodiment, an antisense nucleic acid molecule is antisense to a "coding region" of the coding strand of a nucleotide sequence encoding an SECX and/or NOVX protein. The term "coding region" refers to the region of the nucleotide sequence comprising codons which are translated into amino acid residues. In another embodiment, the antisense nucleic acid molecule is antisense to a "noncoding region" of the coding strand of a nucleotide sequence encoding the SECX and/or NOVX protein. The term "noncoding region" refers to 5' and 3' sequences which flank the coding region that are not translated into amino acids (i.e., also referred to as 5' and 3' untranslated regions).

Given the coding strand sequences encoding the SECX and/or NOVX protein disclosed herein, antisense nucleic acids of the invention can be designed according to the rules of Watson and Crick or Hoogsteen base pairing. The antisense nucleic acid molecule can be complementary to the entire coding region of SECX and/or NOVX mRNA, but more preferably is an oligonucleotide that is antisense to only a portion of the coding or noncoding region of SECX and/or NOVX mRNA. For example, the antisense oligonucleotide can be complementary to the region surrounding the translation start site of SECX and/or NOVX mRNA. An antisense oligonucleotide can be, for example, about 5, 10, 15, 20, 25, 30, 35, 40, 45 or 50 nucleotides in length. An antisense nucleic acid of the invention can be constructed using chemical synthesis or enzymatic ligation reactions using procedures known in the art. For example, an antisense nucleic acid (e.g., an antisense oligonucleotide) can be chemically synthesized using naturally-occurring nucleotides or variously modified nucleotides designed to increase the biological stability of the molecules or to increase the physical stability of the duplex formed between the antisense and sense nucleic acids (e.g., phosphorothioate derivatives and acridine substituted nucleotides can be used).

Examples of modified nucleotides that can be used to generate the antisense nucleic acid include: 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3) w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

The antisense nucleic acid molecules of the invention are typically administered to a subject or generated in situ such that they hybridize with or bind to cellular mRNA and/or genomic DNA encoding an SECX and/or NOVX protein to thereby inhibit expression of the protein (e.g., by inhibiting transcription and/or translation). The hybridization can be by conventional nucleotide complementarity to form a stable duplex, or, for example, in the case of an antisense nucleic acid molecule that binds to DNA duplexes, through specific interactions in the major groove of the double helix. An example of a route of administration of antisense nucleic acid molecules of the invention includes direct injection at a tissue site. Alternatively, antisense nucleic acid molecules can be modified to target selected cells and then administered systemically. For example, for systemic administration, antisense molecules can be modified such that they specifically bind to receptors or antigens expressed on a selected cell surface (e.g., by linking the antisense nucleic acid molecules to peptides or antibodies that bind to cell surface receptors or antigens). The antisense nucleic acid molecules can also be delivered to cells using the vectors described herein. To achieve sufficient nucleic acid molecules, vector constructs in which the antisense nucleic acid molecule is placed under the control of a strong pol II or pol III promoter are preferred.

In yet another embodiment, the antisense nucleic acid molecule of the invention is an α-anomeric nucleic acid molecule. An α-anomeric nucleic acid molecule forms specific double-stranded hybrids with complementary RNA in which, contrary to the usual β-units, the strands run parallel to each other. See, e.g., Gaultier, et al., 1987. *Nucl. Acids Res.* 15: 6625–6641. The antisense nucleic acid molecule can also comprise a 2'-o-methylribonucleotide (See, e.g., Inoue, et al. 1987. *Nucl. Acids Res.* 15: 6131–6148) or a chimeric RNA-DNA analogue (See, e.g., Inoue, et al., 1987. *FEBS Lett.* 215: 327—330.

Ribozymes and PNA Moieties

Nucleic acid modifications include, by way of non-limiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject.

In one embodiment, an antisense nucleic acid of the invention is a ribozyme. Ribozymes are catalytic RNA molecules with ribonuclease activity that are capable of cleaving a single-stranded nucleic acid, such as an mRNA, to which they have a complementary region. Thus, ribozymes (e.g., hammerhead ribozymes as described in Haselhoff and Gerlach 1988. *Nature* 334: 585–591) can be used to catalytically cleave SECX and/or NOVX mRNA transcripts to thereby inhibit translation of SECX and/or NOVX mRNA. A ribozyme having specificity for an SECX and/or NOVX-encoding nucleic acid can be designed based upon the nucleotide sequence of an SECX and/or NOVX cDNA disclosed herein (i.e., SEQ ID NOS:1, 3, 5, 7, 9, 11, 13, 15, 17, 19, 21, 23, 25, 27, 29, 31, 33, 35, 37, 39 and 319). For example, a derivative of a Tetrahymena L-19 IVS RNA can be constructed in which the nucleotide sequence of the active site is complementary to the nucleotide sequence to be cleaved in an SECX and/or NOVX-encoding mRNA. See, e.g., U.S. Pat. No. 4,987,071 to Cech, et al. and U.S. Pat. No. 5,116,742 to Cech, et al. SECX and/or NOVX mRNA can also be used to select a catalytic RNA having a specific ribonuclease activity from a pool of RNA molecules. See, e.g., Bartel et al., (1993) *Science* 261:1411–1418.

Alternatively, SECX and/or NOVX gene expression can be inhibited by targeting nucleotide sequences complementary to the regulatory region of the SECX and/or NOVX nucleic acid (e.g., the SECX and/or NOVX promoter and/or enhancers) to form triple helical structures that prevent transcription of the SECX and/or NOVX gene in target cells.

See, e.g., Helene, 1991. *Anticancer Drug Des.* 6: 569–84; Helene, et al. 1992. *Ann. N.Y. Acad. Sci.* 660: 27–36; Maher, 1992. *Bioassays* 14: 807–15.

In various embodiments, the SECX and/or NOVX nucleic acids can be modified at the base moiety, sugar moiety or phosphate backbone to improve, e.g., the stability, hybridization, or solubility of the molecule. For example, the deoxyribose phosphate backbone of the nucleic acids can be modified to generate peptide nucleic acids. See, e.g., Hyrup, et al., 1996. *Bioorg Med Chem* 4: 5–23. As used herein, the terms "peptide nucleic acids" or "PNAs" refer to nucleic acid mimics (e.g., DNA mimics) in which the deoxyribose phosphate backbone is replaced by a pseudopeptide backbone and only the four natural nucleobases are retained. The neutral backbone of PNAs has been shown to allow for specific hybridization to DNA and RNA under conditions of low ionic strength. The synthesis of PNA oligomers can be performed using standard solid phase peptide synthesis protocols as described in Hyrup, et al., 1996. supra; Perry-O'Keefe, et al., 1996. *Proc. Natl. Acad. Sci. USA* 93: 14670–14675.

PNAs of SECX and/or NOVX can be used in therapeutic and diagnostic applications. For example, PNAs can be used as antisense or antigene agents for sequence-specific modulation of gene expression by, e.g., inducing transcription or translation arrest or inhibiting replication. PNAs of SECX and/or NOVX can also be used, for example, in the analysis of single base pair mutations in a gene (e.g., PNA directed PCR clamping; as artificial restriction enzymes when used in combination with other enzymes, e.g., $S_1$ nucleases (See, Hyrup, et al., 1996.supra); or as probes or primers for DNA sequence and hybridization (See, Hyrup, et al., 1996, supra; Perry-O'Keefe, et al., 1996. supra).

In another embodiment, PNAs of SECX and/or NOVX can be modified, e.g., to enhance their stability or cellular uptake, by attaching lipophilic or other helper groups to PNA, by the formation of PNA-DNA chimeras, or by the use of liposomes or other techniques of drug delivery known in the art. For example, PNA-DNA chimeras of SECX and/or NOVX can be generated that may combine the advantageous properties of PNA and DNA. Such chimeras allow DNA recognition enzymes (e.g., RNase H and DNA polymerases) to interact with the DNA portion while the PNA portion would provide high binding affinity and specificity. PNA-DNA chimeras can be linked using linkers of appropriate lengths selected in terms of base stacking, number of bonds between the nucleobases, and orientation (see, Hyrup, et al., 1996. supra). The synthesis of PNA-DNA chimeras can be performed as described in Hyrup, et al., 1996. supra and Finn, et al., 1996. *Nucl Acids Res* 24: 3357–3363. For example, a DNA chain can be synthesized on a solid support using standard phosphoramidite coupling chemistry, and modified nucleoside analogs, e.g., 5'-(4-methoxytrityl)amino-5'-deoxy-thymidine phosphoramidite, can be used between the PNA and the 5' end of DNA. See, e.g., Mag, et al., 1989. *Nucl Acid Res* 17: 5973–5988. PNA monomers are then coupled in a stepwise manner to produce a chimeric molecule with a 5' PNA segment and a 3' DNA segment. See, e.g., Finn, et al., 1996. supra. Alternatively, chimeric molecules can be synthesized with a 5' DNA segment and a 3' PNA segment. See, e.g., Petersen, et al., 1975. *Bioorg. Med. Chem. Lett.* 5: 1119–11124.

In other embodiments, the oligonucleotide may include other appended groups such as peptides (e.g., for targeting host cell receptors in vivo), or agents facilitating transport across the cell membrane (see, e.g., Letsinger, et al., 1989. *Proc. Natl. Acad. Sci. U.S.A.* 86: 6553–6556; Lemaitre, et al., 1987. *Proc. Natl. Acad. Sci.* 84: 648–652; PCT Publication No. WO88/09810) or the blood-brain barrier (see, e.g., PCT Publication No. WO 89/10134). In addition, oligonucleotides can be modified with hybridization triggered cleavage agents (see, e.g., Krol, et al., 1988. *BioTechniques* 6:958–976) or intercalating agents (see, e.g., Zon, 1988. *Pharm. Res.* 5: 539–549). To this end, the oligonucleotide may be conjugated to another molecule, e.g., a peptide, a hybridization triggered cross-linking agent, a transport agent, a hybridization-triggered cleavage agent, and the like.

SECX and/or NOVX Polypeptides

A polypeptide according to the invention includes a polypeptide including the amino acid sequence of SECX and/or NOVX polypeptides whose sequences are provided in SEQ ID NOS:2, 4, 6, 8, 10, 12, 14, 16, 18, 20, 22, 24, 26, 28, 30, 32, 34, 36, 38, 40 or 320. The invention also includes a mutant or variant protein any of whose residues may be changed from the corresponding residues shown in SEQ ID NOS:2, 4, 6, 8, 10, 12, 14, 16, 18, 20, 22, 24, 26, 28, 30, 32, 34, 36, 38, 40 or 320 while still encoding a protein that maintains its SECX and/or NOVX activities and physiological functions, or a functional fragment thereof.

In general, an SECX and/or NOVX variant that preserves SECX and/or NOVX-like function includes any variant in which residues at a particular position in the sequence have been substituted by other amino acids, and further include the possibility of inserting an additional residue or residues between two residues of the parent protein as well as the possibility of deleting one or more residues from the parent sequence. Any amino acid substitution, insertion, or deletion is encompassed by the invention. In favorable circumstances, the substitution is a conservative substitution as defined above.

One aspect of the invention pertains to isolated SECX and/or NOVX proteins, and biologically-active portions thereof, or derivatives, fragments, analogs or homologs thereof. Also provided are polypeptide fragments suitable for use as immunogens to raise anti-SECX and/or NOVX antibodies. In one embodiment, native SECX and/or NOVX proteins can be isolated from cells or tissue sources by an appropriate purification scheme using standard protein purification techniques. In another embodiment, SECX and/or NOVX proteins are produced by recombinant DNA techniques. Alternative to recombinant expression, an SECX and/or NOVX protein or polypeptide can be synthesized chemically using standard peptide synthesis techniques.

An "isolated" or "purified" polypeptide or protein or biologically-active portion thereof is substantially free of cellular material or other contaminating proteins from the cell or tissue source from which the SECX and/or NOVX protein is derived, or substantially free from chemical precursors or other chemicals when chemically synthesized. The language "substantially free of cellular material" includes preparations of SECX and/or NOVX proteins in which the protein is separated from cellular components of the cells from which it is isolated or recombinantly-produced. In one embodiment, the language "substantially free of cellular material" includes preparations of SECX and/or NOVX proteins having less than about 30% (by dry weight) of non-SECX and/or NOVX proteins (also referred to herein as a "contaminating protein"), more preferably less than about 20% of non-SECX and/or NOVX proteins, still more preferably less than about 10% of non-SECX and/or NOVX proteins, and most preferably less than about 5% of non-SECX and/or NOVX proteins. When the SECX and/or NOVX protein or biologically-active portion thereof is recombinantly-produced, it is also preferably substantially free of culture medium, i.e., culture medium represents less than about 20%, more preferably less than about 10%, and most preferably less than about 5% of the volume of the SECX and/or NOVX protein preparation.

The language "substantially free of chemical precursors or other chemicals" includes preparations of SECX and/or NOVX proteins in which the protein is separated from chemical precursors or other chemicals that are involved in the synthesis of the protein. In one embodiment, the language "substantially free of chemical precursors or other chemicals" includes preparations of SECX and/or NOVX proteins having less than about 30% (by dry weight) of chemical precursors or non-SECX and/or NOVX chemicals, more preferably less than about 20% chemical precursors or non-SECX and/or NOVX chemicals, still more preferably less than about 10% chemical precursors or non-SECX and/or NOVX chemicals, and most preferably less than about 5% chemical precursors or non-SECX and/or NOVX chemicals.

Biologically-active portions of SECX and/or NOVX proteins include peptides comprising amino acid sequences sufficiently homologous to or derived from the amino acid sequences of the SECX and/or NOVX proteins (e.g., the amino acid sequence shown in SEQ ID NOS:2, 4, 6, 8, 10, 12, 14, 16, 18, 20, 22, 24, 26, 28, 30, 32, 34, 36, 38, 40 or 320) that include fewer amino acids than the full-length SECX and/or NOVX proteins, and exhibit at least one activity of an SECX and/or NOVX protein. Typically, biologically-active portions comprise a domain or motif with at least one activity of the SECX and/or NOVX protein. A biologically-active portion of an SECX and/or NOVX protein can be a polypeptide which is, for example, 10, 25, 50, 100 or more amino acid residues in length.

Moreover, other biologically-active portions, in which other regions of the protein are deleted, can be prepared by recombinant techniques and evaluated for one or more of the functional activities of a native SECX and/or NOVX protein.

In an embodiment, the SECX and/or NOVX protein has an amino acid sequence shown SEQ ID NOS:2, 4, 6, 8, 10, 12, 14, 16, 18, 20, 22, 24, 26, 28, 30, 32, 34, 36, 38, 40 or 320. In other embodiments, the SECX and/or NOVX protein is substantially homologous to SEQ ID NOS:2, 4, 6, 8, 10, 12, 14, 16, 18, 20, 22, 24, 26, 28, 30, 32, 34, 36, 38, 40 or 320, and retains the functional activity of the protein of SEQ ID NOS:2, 4, 6, 8, 10, 12, 14, 16, 18, 20, 22, 24, 26, 28, 30, 32, 34, 36, 38, 40 or 320, yet differs in amino acid sequence due to natural allelic variation or mutagenesis, as described in detail, below. Accordingly, in another embodiment, the SECX and/or NOVX protein is a protein that comprises an amino acid sequence at least about 45% homologous to the amino acid sequence SEQ ID NOS:2, 4, 6, 8, 10, 12, 14, 16, 18, 20, 22, 24, 26, 28, 30, 32, 34, 36, 38, 40 or 320, and retains the functional activity of the SECX and/or NOVX proteins of SEQ ID NOS:2, 4, 6, 8, 10, 12, 14, 16, 18, 20, 22, 24, 26, 28, 30, 32, 34, 36, 38, 40 or 320.

Determining Homology Between Two or More Sequences

To determine the percent homology of two amino acid sequences or of two nucleic acids, the sequences are aligned for optimal comparison purposes (e.g., gaps can be introduced in the sequence of a first amino acid or nucleic acid sequence for optimal alignment with a second amino or nucleic acid sequence). The amino acid residues or nucleotides at corresponding amino acid positions or nucleotide positions are then compared. When a position in the first sequence is occupied by the same amino acid residue or nucleotide as the corresponding position in the second sequence, then the molecules are homologous at that position (i.e., as used herein amino acid or nucleic acid "homology" is equivalent to amino acid or nucleic acid "identity").

The nucleic acid sequence homology may be determined as the degree of identity between two sequences. The homology may be determined using computer programs known in the art, such as GAP software provided in the GCG program package. See, Needleman and Wunsch, 1970. *J Mol Biol* 48: 443–453. Using GCG GAP software with the following settings for nucleic acid sequence comparison: GAP creation penalty of 5.0 and GAP extension penalty of 0.3, the coding region of the analogous nucleic acid sequences referred to above exhibits a degree of identity preferably of at least 70%, 75%, 80%, 85%, 90%, 95%, 98%, or 99%, with the CDS (encoding) part of the DNA sequence shown in SEQ ID NOS:1, 3, 5, 7, 9, 11, 13, 15, 17, 19, 21, 23, 25, 27, 29, 31, 33, 35, 37, 39 and 319.

The term "sequence identity" refers to the degree to which two polynucleotide or polypeptide sequences are identical on a residue-by-residue basis over a particular region of comparison. The term "percentage of sequence identity" is calculated by comparing two optimally aligned sequences over that region of comparison, determining the number of positions at which the identical nucleic acid base (e.g., A, T, C, G, U, or I, in the case of nucleic acids) occurs in both sequences to yield the number of matched positions, dividing the number of matched positions by the total number of positions in the region of comparison (i.e., the window size), and multiplying the result by 100 to yield the percentage of sequence identity. The term "substantial identity" as used herein denotes a characteristic of a polynucleotide sequence, wherein the polynucleotide comprises a sequence that has at least 80 percent sequence identity, preferably at least 85 percent identity and often 90 to 95 percent sequence identity, more usually at least 99 percent sequence identity as compared to a reference sequence over a comparison region.

Chimeric and Fusion Proteins

The invention also provides SECX and/or NOVX chimeric or fusion proteins. As used herein, an SECX and/or NOVX "chimeric protein" or "fusion protein" comprises an SECX and/or NOVX polypeptide operatively-linked to a non-SECX and/or NOVX polypeptide. An "SECX and/or NOVX polypeptide" refers to a polypeptide having an amino acid sequence corresponding to an SECX and/or NOVX protein SEQ ID NOS:2, 4, 6, 8, 10, 12, 14, 16, 18, 20, 22, 24, 26, 28, 30, 32, 34, 36, 38, 40 or 320, whereas a "non-SECX and/or NOVX polypeptide" refers to a polypeptide having an amino acid sequence corresponding to a protein that is not substantially homologous to the SECX and/or NOVX protein, e.g., a protein that is different from the SECX and/or NOVX protein and that is derived from the same or a different organism. Within an SECX and/or NOVX fusion protein the SECX and/or NOVX polypeptide can correspond to all or a portion of an SECX and/or NOVX protein. In one embodiment, an SECX and/or NOVX fusion protein comprises at least one biologically-active portion of an SECX and/or NOVX protein. In another embodiment, an SECX and/or NOVX fusion protein comprises at least two biologically-active portions of an SECX and/or NOVX protein. In yet another embodiment, an SECX and/or NOVX fusion protein comprises at least three biologically-active portions of an SECX and/or NOVX protein. Within the fusion protein, the term "operatively-linked" is intended to indicate that the SECX and/or NOVX polypeptide and the non-SECX and/or NOVX polypeptide are fused in-frame with one another. The non-SECX and/or NOVX polypeptide can be fused to the N-terminus or C-terminus of the SECX and/or NOVX polypeptide.

In one embodiment, the fusion protein is a GST-SECX and/or NOVX fusion protein in which the SECX and/or NOVX sequences are fused to the C-terminus of the GST (glutathione S-transferase) sequences. Such fusion proteins can facilitate the purification of recombinant SECX and/or NOVX polypeptides.

In another embodiment, the fusion protein is an SECX and/or NOVX protein containing a heterologous signal sequence at its N-terminus. In certain host cells (e.g., mammalian host cells), expression and/or secretion of SECX and/or NOVX can be increased through use of a heterologous signal sequence.

In yet another embodiment, the fusion protein is an SECX and/or NOVX-immunoglobulin fusion protein in which the SECX and/or NOVX sequences are fused to sequences derived from a member of the immunoglobulin protein family. The SECX and/or NOVX-immunoglobulin fusion proteins of the invention can be incorporated into pharmaceutical compositions and administered to a subject to inhibit an interaction between an SECX and/or NOVX ligand and an SECX and/or NOVX protein on the surface of a cell, to thereby suppress SECX and/or NOVX-mediated signal transduction in vivo. The SECX and/or NOVX-immunoglobulin fusion proteins can be used to affect the bioavailability of an SECX and/or NOVX cognate ligand. Inhibition of the SECX and/or NOVX ligand/SECX and/or NOVX interaction may be useful therapeutically for both the treatment of proliferative and differentiative disorders, as well as modulating (e.g. promoting or inhibiting) cell survival. Moreover, the SECX and/or NOVX-immunoglobulin fusion proteins of the invention can be used as immunogens to produce anti-SECX and/or NOVX antibodies in a subject, to purify SECX and/or NOVX ligands, and in screening assays to identify molecules that inhibit the interaction of SECX and/or NOVX with an SECX and/or NOVX ligand.

An SECX and/or NOVX chimeric or fusion protein of the invention can be produced by standard recombinant DNA techniques. For example, DNA fragments coding for the different polypeptide sequences are ligated together in-frame in accordance with conventional techniques, e.g., by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers that give rise to complementary overhangs between two consecutive gene fragments that can subsequently be annealed and reamplified to generate a chimeric gene sequence (see, e.g., Ausubel, et al. (eds.) CURRENT PROTOCOLS IN MOLECULAR BIOLOGY, John Wiley & Sons, 1992). Moreover, many expression vectors are commercially available that already encode a fusion moiety (e.g., a GST polypeptide). An SECX and/or NOVX-encoding nucleic acid can be cloned into such an expression vector such that the fusion moiety is linked in-frame to the SECX and/or NOVX protein.

SECX and/or NOVX Agonists and Antagonists

The invention also pertains to variants of the SECX and/or NOVX proteins that function as either SECX and/or NOVX agonists (i.e., mimetics) or as SECX and/or NOVX antagonists. Variants of the SECX and/or NOVX protein can be generated by mutagenesis (e.g., discrete point mutation or truncation of the SECX and/or NOVX protein). An agonist of the SECX and/or NOVX protein can retain substantially the same, or a subset of, the biological activities of the naturally occurring form of the SECX and/or NOVX protein. An antagonist of the SECX and/or NOVX protein can inhibit one or more of the activities of the naturally occurring form of the SECX and/or NOVX protein by, for example, competitively binding to a downstream or upstream member of a cellular signaling cascade which includes the SECX and/or NOVX protein. Thus, specific biological effects can be elicited by treatment with a variant of limited function. In one embodiment, treatment of a subject with a variant having a subset of the biological activities of the naturally occurring form of the protein has fewer side effects in a subject relative to treatment with the naturally occurring form of the SECX and/or NOVX proteins.

Variants of the SECX and/or NOVX proteins that function as either SECX and/or NOVX agonists (i.e., mimetics) or as SECX and/or NOVX antagonists can be identified by screening combinatorial libraries of mutants (e.g., truncation mutants) of the SECX and/or NOVX proteins for SECX and/or NOVX protein agonist or antagonist activity. In one embodiment, a variegated library of SECX and/or NOVX variants is generated by combinatorial mutagenesis at the nucleic acid level and is encoded by a variegated gene library. A variegated library of SECX and/or NOVX variants can be produced by, for example, enzymatically ligating a mixture of synthetic oligonucleotides into gene sequences such that a degenerate set of potential SECX and/or NOVX sequences is expressible as individual polypeptides, or alternatively, as a set of larger fusion proteins (e.g., for phage display) containing the set of SECX and/or NOVX sequences therein. There are a variety of methods which can be used to produce libraries of potential SECX and/or NOVX variants from a degenerate oligonucleotide sequence. Chemical synthesis of a degenerate gene sequence can be performed in an automatic DNA synthesizer, and the synthetic gene then ligated into an appropriate expression vector. Use of a degenerate set of genes allows for the provision, in one mixture, of all of the sequences encoding the desired set of potential SECX and/or NOVX sequences. Methods for synthesizing degenerate oligonucleotides are well-known within the art. See, e.g., Narang, 1983. *Tetrahedron* 39: 3; Itakura, et al., 1984. *Annu. Rev. Biochem.* 53: 323; Itakura, et al., 1984. *Science* 198: 1056; Ike, et al., 1983. *Nucl. Acids Res.* 11: 477.

Polypeptide Libraries

In addition, libraries of fragments of the SECX and/or NOVX protein coding sequences can be used to generate a variegated population of SECX and/or NOVX fragments for screening and subsequent selection of variants of an SECX and/or NOVX protein. In one embodiment, a library of coding sequence fragments can be generated by treating a double stranded PCR fragment of an SECX and/or NOVX coding sequence with a nuclease under conditions wherein nicking occurs only about once per molecule, denaturing the double stranded DNA, renaturing the DNA to form double-stranded DNA that can include sense/antisense pairs from different nicked products, removing single stranded portions from reformed duplexes by treatment with S1 nuclease, and ligating the resulting fragment library into an expression vector. By this method, expression libraries can be derived which encodes N-terminal and internal fragments of various sizes of the SECX and/or NOVX proteins.

Various techniques are known in the art for screening gene products of combinatorial libraries made by point mutations or truncation, and for screening cDNA libraries for gene products having a selected property. Such techniques are adaptable for rapid screening of the gene libraries generated by the combinatorial mutagenesis of SECX and/or NOVX proteins. The most widely used techniques, which are amenable to high throughput analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a new technique that enhances the frequency of functional mutants in the libraries, can be used in combination with the screening assays to identify SECX and/or NOVX variants. See, e.g., Arkin and Yourvan, 1992. *Proc. Natl. Acad. Sci. USA* 89: 7811–7815; Delgrave, et al., 1993. *Protein Engineering* 6:327–331.

SECX and/or NOVX Antibodies

The term "antibody" as used herein refers to immunoglobulin molecules and immunologically active portions of immunoglobulin (Ig) molecules, i.e., molecules that contain an antigen binding site that specifically binds (immunoreacts with) an antigen. Such antibodies include, but are not limited to, polyclonal, monoclonal, chimeric, single chain, $F_{ab}$, $F_{ab'}$ and $F_{(ab')2}$ fragments, and an $F_{ab}$ expression library. In general, antibody molecules obtained from humans relates to any of the classes IgG, IgM, IgA, IgE and IgD, which differ from one another by the nature of the heavy chain present in the molecule. Certain classes have subclasses as well, such as $IgG_1$, $IgG_2$, and others. Furthermore, in humans, the light chain may be a kappa chain or a lambda chain. Reference herein to antibodies includes a reference to all such classes, subclasses and types of human antibody species.

An isolated protein of the invention intended to serve as an antigen, or a portion or fragment thereof, can be used as an immunogen to generate antibodies that immunospecifically bind the antigen, using standard techniques for polyclonal and monoclonal antibody preparation. The full-length protein can be used or, alternatively, the invention provides antigenic peptide fragments of the antigen for use as immunogens. An antigenic peptide fragment comprises at least 6 amino acid residues of the amino acid sequence of the full length protein, such as an amino acid sequence shown in SEQ ID NOs: 2, 4, 6, 8, 10, 12, 14, 16, 18, 20, 22, 24, 26, 28, 30, 32, 34, 36, 38, 40 and 320, and encompasses an epitope thereof such that an antibody raised against the peptide forms a specific immune complex with the full length protein or with any fragment that contains the epitope. Preferably, the antigenic peptide comprises at least 10 amino acid residues, or at least 15 amino acid residues, or at least 20 amino acid residues, or at least 30 amino acid residues. Preferred epitopes encompassed by the antigenic peptide are regions of the protein that are located on its surface; commonly these are hydrophilic regions.

In certain embodiments of the invention, at least one epitope encompassed by the anti genic peptide is a region of SECX and/or NOVX that is located on the surface of the protein, e.g., a hydrophilic region. A hydrophobicity analysis of the human SECX and/or NOVX protein sequence will indicate which regions of a SECX and/or NOVX polypeptide are particularly hydrophilic and, therefore, are likely to encode surface residues useful for targeting antibody production. As a means for targeting antibody production, hydropathy plots showing regions of hydrophilicity and hydrophobicity may be generated by any method well known in the art, including, for example, the Kyte Doolittle or the Hopp Woods methods, either with or without Fourier transformation. See, e.g., Hopp and Woods, 1981, *Proc. Nat. Acad. Sci. USA* 78: 3824–3828; Kyte and Doolittle 1982, *J. Mol. Biol.* 157: 105–142, each incorporated herein by reference in their entirety. Antibodies that are specific for one or more domains within an antigenic protein, or derivatives, fragments, analogs or homologs thereof, are also provided herein.

A protein of the invention, or a derivative, fragment, analog, homolog or ortholog thereof, may be utilized as an immunogen in the generation of antibodies that immunospecifically bind these protein components.

Various procedures known within the art may be used for the production of polyclonal or monoclonal antibodies directed against a protein of the invention, or against derivatives, fragments, analogs homologs or orthologs thereof (see, for example, Antibodies: A Laboratory Manual, Harlow E, and Lane D, 1988, Cold Spring Harbor Laboratory Press, Cold Spring Harbor, N.Y., incorporated herein by reference). Some of these antibodies are discussed below.

Polyclonal Antibodies

For the production of polyclonal antibodies, various suitable host animals (e.g., rabbit, goat, mouse or other mammal) may be immunized by one or more injections with the native protein, a synthetic variant thereof, or a derivative of the foregoing. An appropriate immunogenic preparation can contain, for example, the naturally occurring immunogenic protein, a chemically synthesized polypeptide representing the immunogenic protein, or a recombinantly expressed immunogenic protein. Furthermore, the protein may be conjugated to a second protein known to be immunogenic in the mammal being immunized. Examples of such immunogenic proteins include but are not limited to keyhole limpet hemocyanin, serum albumin, bovine thyroglobulin, and soybean trypsin inhibitor. The preparation can further include an adjuvant. Various adjuvants used to increase the immunological response include, but are not limited to, Freund's (complete and incomplete), mineral gels (e.g., aluminum hydroxide), surface active substances (e.g., lysolecithin, pluronic polyols, polyanions, peptides, oil emulsions, dinitrophenol, etc.), adjuvants usable in humans such as Bacille Calmette-Guerin and *Corynebacterium parvum*, or similar immunostimulatory agents. Additional examples of adjuvants which can be employed include MPL-TDM adjuvant (monophosphoryl Lipid A, synthetic trehalose dicorynomycolate).

The polyclonal antibody molecules directed against the immunogenic protein can be isolated from the mammal (e.g., from the blood) and further purified by well known techniques, such as affinity chromatography using protein A or protein G, which provide primarily the IgG fraction of immune serum. Subsequently, or alternatively, the specific antigen which is the target of the immunoglobulin sought, or an epitope thereof, may be immobilized on a column to purify the immune specific antibody by immunoaffinity chromatography. Purification of immunoglobulins is discussed, for example, by D. Wilkinson (The Scientist, published by The Scientist, Inc., Philadelphia Pa., Vol. 14, No. 8 (Apr. 17, 2000), pp. 25–28).

Monoclonal Antibodies

The term "monoclonal antibody" (MAb) or "monoclonal antibody composition", as used herein, refers to a population of antibody molecules that contain only one molecular species of antibody molecule consisting of a unique light chain gene product and a unique heavy chain gene product. In particular, the complementarity determining regions (CDRs) of the monoclonal antibody are identical in all the molecules of the population. MAbs thus contain an antigen binding site capable of immunoreacting with a particular epitope of the antigen characterized by a unique binding affinity for it.

Monoclonal antibodies can be prepared using hybridoma methods, such as those described by Kohler and Milstein, Nature, 256:495 (1975). In a hybridoma method, a mouse, hamster, or other appropriate host animal, is typically immunized with an immunizing agent to elicit lymphocytes that produce or are capable of producing antibodies that will specifically bind to the immunizing agent. Alternatively, the lymphocytes can be immunized in vitro.

The immunizing agent will typically include the protein antigen, a fragment thereof or a fusion protein thereof. Generally, either peripheral blood lymphocytes are used if cells of human origin are desired, or spleen cells or lymph node cells are used if non-human mammalian sources are desired. The lymphocytes are then fused with an immortalized cell line using a suitable fusing agent, such as polyethylene glycol, to form a hybridoma cell [Goding, *Monoclonal Antibodies: Principles and Practice*, Academic Press, (1986) pp. 59–103]. Immortalized cell lines are usually transformed mammalian cells, particularly myeloma cells of rodent, bovine and human origin. Usually, rat or mouse myeloma cell lines are employed. The hybridoma cells can be cultured in a suitable culture medium that preferably contains one or more substances that inhibit the growth or survival of the unfused, immortalized cells. For example, if the parental cells lack the enzyme hypoxanthine guanine phosphoribosyl transferase (HGPRT or HPRT), the culture medium for the hybridomas typically will include hypoxanthine, aminopterin, and thymidine ("HAT medium"), which substances prevent the growth of HGPRT-deficient cells.

Preferred immortalized cell lines are those that fuse efficiently, support stable high level expression of antibody by the selected antibody-producing cells, and are sensitive to a medium such as HAT medium. More preferred immortalized cell lines are murine myeloma lines, which can be obtained, for instance, from the Salk Institute Cell Distribution Center, San Diego, Calif. and the American Type Culture Collection, Manassas, Va. Human myeloma and mouse-human heteromyeloma cell lines also have been described for the production of human monoclonal antibodies [Kozbor, *J. Immunol.*, 133:3001 (1984); Brodeur et al., *Monoclonal Antibody Production Techniques and Applications*, Marcel Dekker, Inc., New York, (1987) pp. 51–63].

The culture medium in which the hybridoma cells are cultured can then be assayed for the presence of monoclonal antibodies directed against the antigen. Preferably, the binding specificity of monoclonal antibodies produced by the hybridoma cells is determined by immunoprecipitation or by an in vitro binding assay, such as radioimmunoassay (RIA) or enzyme-linked immunoabsorbent assay (ELISA). Such techniques and assays are known in the art. The binding affinity of the monoclonal antibody can, for example, be determined by the Scatchard analysis of Munson and Pollard, *Anal. Biochem.*, 107:220 (1980). It is an objective, especially important in therapeutic applications of monoclonal antibodies, to identify antibodies having a high degree of specificity and a high binding affinity for the target antigen.

After the desired hybridoma cells are identified, the clones can be subcloned by limiting dilution procedures and grown by standard methods (Goding, 1986). Suitable culture media for this purpose include, for example, Dulbecco's Modified Eagle's Medium and RPMI-1640 medium. Alternatively, the hybridoma cells can be grown in vivo as ascites in a mammal.

The monoclonal antibodies secreted by the subclones can be isolated or purified from the culture medium or ascites fluid by conventional immunoglobulin purification procedures such as, for example, protein A-Sepharose, hydroxylapatite chromatography, gel electrophoresis, dialysis, or affinity chromatography.

The monoclonal antibodies can also be made by recombinant DNA methods, such as those described in U.S. Pat. No. 4,816,567. DNA encoding the monoclonal antibodies of the invention can be readily isolated and sequenced using conventional procedures (e.g., by using oligonucleotide probes that are capable of binding specifically to genes encoding the heavy and light chains of murine antibodies). The hybridoma cells of the invention serve as a preferred source of such DNA. Once isolated, the DNA can be placed into expression vectors, which are then transfected into host cells such as simian COS cells, Chinese hamster ovary (CHO) cells, or myeloma cells that do not otherwise produce immunoglobulin protein, to obtain the synthesis of monoclonal antibodies in the recombinant host cells. The DNA also can be modified, for example, by substituting the coding sequence for human heavy and light chain constant domains in place of the homologous murine sequences (U.S. Pat. No. 4,816,567; Morrison, *Nature* 368, 812–13 (1994)) or by covalently joining to the immunoglobulin coding sequence all or part of the coding sequence for a non-immunoglobulin polypeptide. Such a non-immunoglobulin polypeptide can be substituted for the constant domains of an antibody of the invention, or can be substituted for the variable domains of one antigen-combining site of an antibody of the invention to create a chimeric bivalent antibody.

Humanized Antibodies

The antibodies directed against the protein antigens of the invention can further comprise humanized antibodies or human antibodies. These antibodies are suitable for administration to humans without engendering an immune response by the human against the administered immunoglobulin. Humanized forms of antibodies are chimeric immunoglobulins, immunoglobulin chains or fragments thereof (such as Fv, Fab, Fab', F(ab')$_2$ or other antigen-binding subsequences of antibodies) that are principally comprised of the sequence of a human immunoglobulin, and contain minimal sequence derived from a non-human immunoglobulin. Humanization can be performed following the method of Winter and co-workers (Jones et al., *Nature*, 321:522–525 (1986); Riechmann et al., *Nature*, 332:323–327 (1988); Verhoeyen et al., *Science*, 239:1534–1536 (1988)), by substituting rodent CDRs or CDR sequences for the corresponding sequences of a human antibody. (See also U.S. Pat. No. 5,225,539.) In some instances, Fv framework residues of the human immunoglobulin are replaced by corresponding non-human residues. Humanized antibodies can also comprise residues which are found neither in the recipient antibody nor in the imported CDR or framework sequences. In general, the humanized antibody will comprise substantially all of at least one, and typically two, variable domains, in which all or substantially all of the CDR regions correspond to those of a non-human immunoglobulin and all or substantially all of the framework regions are those of a human immunoglobulin consensus sequence. The humanized antibody optimally also will comprise at least a portion of an immunoglobulin constant region (Fc), typically that of a human immunoglobulin (Jones et al., 1986; Riechmann et al., 1988; and Presta, *Curr. Op. Struct. Biol.*, 2:593–596 (1992)).

Human Antibodies

Fully human antibodies essentially relate to antibody molecules in which the entire sequence of both the light chain and the heavy chain, including the CDRs, arise from human genes. Such antibodies are termed "human antibodies", or "fully human antibodies" herein. Human monoclonal antibodies can be prepared by the trioma technique; the human B-cell hybridoma technique (see Kozbor, et al., 1983 Immunol Today 4: 72) and the EBV hybridoma technique to produce human monoclonal antibodies (see Cole, et al., 1985 In: MONOCLONAL ANTIBODIES AND CANCER THERAPY, Alan R. Liss, Inc., pp. 77–96). Human monoclonal antibodies may be utilized in the practice of the present invention and may be produced by using human hybridomas (see Cote, et al., 1983. *Proc Natl Acad Sci USA* 80: 2026–2030) or by transforming human B-cells with Epstein Barr Virus in vitro (see Cole, et al., 1985 In: MONOCLONAL ANTIBODIES AND CANCER THERAPY, Alan R. Liss, Inc., pp. 77–96).

In addition, human antibodies can also be produced using additional techniques, including phage display libraries (Hoogenboom and Winter, *J. Mol. Biol.*, 227:381 (1991); Marks et al., *J. Mol. Biol.*, 222:581 (1991)). Similarly, human antibodies can be made by introducing human immunoglobulin loci into transgenic animals, e.g., mice in which the endogenous immunoglobulin genes have been partially or completely inactivated. Upon challenge, human antibody production is observed, which closely resembles that seen in humans in all respects, including gene rearrangement, assembly, and antibody repertoire. This approach is described, for example, in U.S. Pat. Nos. 5,545,807; 5,545,806; 5,569,825; 5,625,126; 5,633,425; 5,661,016, and in Marks et al. (*Bio/Technology* 10, 779–783 (1992)); Lonberg et al. (*Nature* 368 856–859 (1994)); Morrison (*Nature* 368, 812–13 (1994)); Fishwild et al, (*Nature Biotechnology* 14, 845–51 (1996)); Neuberger (*Nature Biotechnology* 14, 826 (1996)); and Lonberg and Huszar (*Intern. Rev. Immunol.* 13 65–93 (1995)).

Human antibodies may additionally be produced using transgenic nonhuman animals which are modified so as to produce fully human antibodies rather than the animal's endogenous antibodies in response to challenge by an antigen. (See PCT publication WO94/02602). The endogenous genes encoding the heavy and light immunoglobulin chains in the nonhuman host have been incapacitated, and active loci encoding human heavy and light chain immunoglobulins are inserted into the host's genome. The human genes are incorporated, for example, using yeast artificial chromosomes containing the requisite human DNA segments. An animal which provides all the desired modifications is then obtained as progeny by crossbreeding intermediate transgenic animals containing fewer than the full complement of the modifications. The preferred embodiment of such a nonhuman animal is a mouse, and is termed the Xenomouse™ as disclosed in PCT publications WO 96/33735 and WO 96/34096. This animal produces B cells which secrete fully human immunoglobulins. The antibodies can be obtained directly from the animal after immunization with an immunogen of interest, as, for example, a preparation of a polyclonal antibody, or alternatively from immortalized B cells derived, from the animal, such as hybridomas producing monoclonal antibodies. Additionally, the genes encoding the immunoglobulins with human variable regions can be recovered and expressed to obtain the antibodies directly, or can be further modified to obtain analogs of antibodies such as, for example, single chain Fv molecules.

An example of a method of producing a nonhuman host, exemplified as a mouse, lacking expression of an endogenous immunoglobulin heavy chain is disclosed in U.S. Pat. No. 5,939,598. It can be obtained by a method including deleting the J segment genes from at least one endogenous heavy chain locus in an embryonic stem cell to prevent rearrangement of the locus and to prevent formation of a transcript of a rearranged immunoglobulin heavy chain locus, the deletion being effected by a targeting vector containing a gene encoding a selectable marker; and producing from the embryonic stem cell a transgenic mouse whose somatic and germ cells contain the gene encoding the selectable marker.

A method for producing an antibody of interest, such as a human antibody, is disclosed in U.S. Pat. No. 5,916,771. It includes introducing an expression vector that contains a nucleotide sequence encoding a heavy chain into one mammalian host cell in culture, introducing an expression vector containing a nucleotide sequence encoding a light chain into another mammalian host cell, and fusing the two cells to form a hybrid cell. The hybrid cell expresses an antibody containing the heavy chain and the light chain.

In a further improvement on this procedure, a method for identifying a clinically relevant epitope on an immunogen, and a correlative method for selecting an antibody that binds immunospecifically to the relevant epitope with high affinity, are disclosed in PCT publication WO 99/53049.

$F_{ab}$ Fragments and Single Chain Antibodies

According to the invention, techniques can be adapted for the production of single-chain antibodies specific to an antigenic protein of the invention (see e.g., U.S. Pat. No. 4,946,778). In addition, methods can be adapted for the construction of $F_{ab}$ expression libraries (see e.g., Huse, et al., 1989 Science 246: 1275–1281) to allow rapid and effective identification of monoclonal $F_{ab}$ fragments with the desired specificity for a protein or derivatives, fragments, analogs or homologs thereof. Antibody fragments that contain the idiotypes to a protein antigen may be produced by techniques known in the art including, but not limited to: (i) an $F_{(ab')2}$ fragment produced by pepsin digestion of an antibody molecule; (ii) an $F_{ab}$ fragment generated by reducing the disulfide bridges of an $F_{(ab')2}$ fragment; (iii) an $F_{ab}$ fragment generated by the treatment of the antibody molecule with papain and a reducing agent and (iv) $F_v$ fragments.

Bispecific Antibodies

Bispecific antibodies are monoclonal, preferably human or humanized, antibodies that have binding specificities for at least two different antigens. In the present case, one of the binding specificities is for an antigenic protein of the invention. The second binding target is any other antigen, and advantageously is a cell-surface protein or receptor or receptor subunit.

Methods for making bispecific antibodies are known in the art. Traditionally, the recombinant production of bispecific antibodies is based on the co-expression of two immunoglobulin heavy-chain/light-chain pairs, where the two heavy chains have different specificities (Milstein and Cuello, Nature, 305:537–539 (1983)). Because of the random assortment of immunoglobulin heavy and light chains, these hybridomas (quadromas) produce a potential mixture of ten different antibody molecules, of which only one has the correct bispecific structure. The purification of the correct molecule is usually accomplished by affinity chromatography steps. Similar procedures are disclosed in WO 93/08829, published May 13, 1993, and in Traunecker et al., *EMBO J.*, 10:3655–3659 (1991).

Antibody variable domains with the desired binding specificities (antibody-antigen combining sites) can be fused to immunoglobulin constant domain sequences. The fusion preferably is with an immunoglobulin heavy-chain constant domain, comprising at least part of the hinge, CH2, and CH3 regions. It is preferred to have the first heavy-chain constant region (CH1) containing the site necessary for light-chain binding present in at least one of the fusions. DNAs encoding the immunoglobulin heavy-chain fusions and, if desired, the immunoglobulin light chain, are inserted into separate expression vectors, and are co-transfected into a suitable host organism. For further details of generating bispecific antibodies see, for example, Suresh et al., *Methods in Enzymology*, 121:210 (1986).

According to another approach described in WO 96/27011, the interface between a pair of antibody molecules can be engineered to maximize the percentage of heterodimers which are recovered from recombinant cell culture. The preferred interface comprises at least a part of the CH3 region of an antibody constant domain. In this method, one or more small amino acid side chains from the interface of the first antibody molecule are replaced with larger side chains (e.g. tyrosine or tryptophan). Compensatory "cavities" of identical or similar size to the large side chain(s) are created on the interface of the second antibody molecule by replacing large amino acid side chains with smaller ones (e.g. alanine or threonine). This provides a mechanism for increasing the yield of the heterodimer over other unwanted end-products such as homodimers.

Bispecific antibodies can be prepared as full length antibodies or antibody fragments (e.g. F(ab')$_2$ bispecific antibodies). Techniques for generating bispecific antibodies from antibody fragments have been described in the literature. For example, bispecific antibodies can be prepared using chemical linkage. Brennan et al., *Science* 229:81 (1985) describe a procedure wherein intact antibodies are proteolytically cleaved to generate F(ab')$_2$ fragments. These fragments are reduced in the presence of the dithiol complexing agent sodium arsenite to stabilize vicinal dithiols and prevent intermolecular disulfide formation. The Fab' fragments generated are then converted to thionitrobenzoate (TNB) derivatives. One of the Fab'-TNB derivatives is then reconverted to the F$_{ab'}$-thiol by reduction with mercaptoethylamine and is mixed with an equimolar amount of the other F$_{ab'}$-TNB derivative to form the bispecific antibody. The bispecific antibodies produced can be used as agents for the selective immobilization of enzymes.

Additionally, Fab' fragments can be directly recovered from *E. coli* and chemically coupled to form bispecific antibodies. Shalaby et al., *J. Exp. Med.* 175:217–225 (1992) describe the production of a fully humanized bispecific antibody F(ab')$_2$ molecule. Each Fab' fragment was separately secreted from *E. coli* and subjected to directed chemical coupling in vitro to form the bispecific antibody. The bispecific antibody thus formed was able to bind to cells overexpressing the ErbB2 receptor and normal human T cells, as well as trigger the lytic activity of human cytotoxic lymphocytes against human breast tumor targets.

Various techniques for making and isolating bispecific antibody fragments directly from recombinant cell culture have also been described. For example, bispecific antibodies have been produced using leucine zippers. Kostelny et al., *J. Immunol.* 148(5): 1547–1553 (1992). The leucine zipper peptides from the Fos and Jun proteins were linked to the Fab' portions of two different antibodies by gene fusion. The antibody homodimers were reduced at the hinge region to form monomers and then re-oxidized to form the antibody heterodimers. This method can also be utilized for the production of antibody homodimers. The "diabody" technology described by Hollinger et al., *Proc. Natl. Acad. Sci. USA* 90:6444–6448 (1993) has provided an alternative mechanism for making bispecific antibody fragments. The fragments comprise a heavy-chain variable domain (V$_H$) connected to a light-chain variable domain (V$_L$) by a linker which is too short to allow pairing between the two domains on the same chain. Accordingly, the V$_H$ and V$_L$ domains of one fragment are forced to pair with the complementary V$_L$ and V$_H$ domains of another fragment, thereby forming two antigen-binding sites. Another strategy for making bispecific antibody fragments by the use of single-chain Fv (sFv) dimers has also been reported. See, Gruber et al., *J. Immunol.* 152:5368 (1994).

Antibodies with more than two valencies are contemplated. For example, trispecific antibodies can be prepared. Tutt et al., *J. Immunol.* 147:60 (1991).

Exemplary bispecific antibodies can bind to two different epitopes, at least one of which originates in the protein antigen of the invention. Alternatively, an anti-antigenic arm of an immunoglobulin molecule can be combined with an arm which binds to a triggering molecule on a leukocyte such as a T-cell receptor molecule (e.g. CD2, CD3, CD28, or B7), or Fc receptors for IgG (FcγR), such as FcγRI (CD64), FcγRII (CD32) and FcγRIII (CD16) so as to focus cellular defense mechanisms to the cell expressing the particular antigen. Bispecific antibodies can also be used to direct cytotoxic agents to cells which express a particular antigen. These antibodies possess an antigen-binding arm and an arm which binds a cytotoxic agent or a radionuclide chelator, such as EOTUBE, DPTA, DOTA, or TETA. Another bispecific antibody of interest binds the protein antigen described herein and further binds tissue factor (TF).

Heteroconjugate Antibodies

Heteroconjugate antibodies are also within the scope of the present invention. Heteroconjugate antibodies are composed of two covalently joined antibodies. Such antibodies have, for example, been proposed to target immune system cells to unwanted cells (U.S. Pat. No. 4,676,980), and for treatment of HIV infection (WO 91/00360; WO 92/200373; EP 03089). It is contemplated that the antibodies can be prepared in vitro using known methods in synthetic protein chemistry, including those involving crosslinking agents. For example, immunotoxins can be constructed using a disulfide exchange reaction or by forming a thioether bond. Examples of suitable reagents for this purpose include iminothiolate and methyl-4-mercaptobutyrimidate and those disclosed, for example, in U.S. Pat. No. 4,676,980.

Effector Function Engineering

It can be desirable to modify the antibody of the invention with respect to effector function, so as to enhance, e.g., the effectiveness of the antibody in treating cancer. For example, cysteine residue(s) can be introduced into the Fc region, thereby allowing interchain disulfide bond formation in this region. The homodimeric antibody thus generated can have improved internalization capability and/or increased complement-mediated cell killing and antibody-dependent cellular cytotoxicity (ADCC). See Caron et al., *J. Exp Med.*, 176: 1191–1195 (1992) and Shopes, *J. Immunol.*, 148: 2918–2922 (1992). Homodimeric antibodies with enhanced anti-tumor activity can also be prepared using heterobifunctional cross-linkers as described in Wolff et al. *Cancer Research*, 53: 2560–2565 (1993). Alternatively, an antibody can be engineered that has dual Fc regions and can thereby have enhanced complement lysis and ADCC capabilities. See Stevenson et al., *Anti-Cancer Drug Design*, 3: 219–230 (1989).

Immunoconjugates

The invention also pertains to immunoconjugates comprising an antibody conjugated to a cytotoxic agent such as a chemotherapeutic agent, toxin (e.g., an enzymatically active toxin of bacterial, fungal, plant, or animal origin, or fragments thereof), or a radioactive isotope (i.e., a radioconjugate).

Chemotherapeutic agents useful in the generation of such immunoconjugates have been described above. Enzymatically active toxins and fragments thereof that can be used include diphtheria A chain, nonbinding active fragments of diphtheria toxin, exotoxin A chain (from Pseudomonas aeruginosa), ricin A chain, abrin A chain, modeccin A chain, alpha-sarcin, Aleurites fordii proteins, dianthin proteins, Phytolaca americana proteins (PAPI, PAPII, and PAP-S), momordica charantia inhibitor, curcin, crotin, sapaonaria officinalis inhibitor, gelonin, mitogellin, restrictocin, phenomycin, enomycin, and the tricothecenes. A variety of radionuclides are available for the production of radioconjugated antibodies. Examples include $^{212}$Bi, $^{131}$I, $^{131}$In, $^{90}$Y, and $^{186}$Re.

Conjugates of the antibody and cytotoxic agent are made using a variety of bifunctional protein-coupling agents such as N-succinimidyl-3-(2-pyridyldithiol) propionate (SPDP), iminothiolane (IT), bifunctional derivatives of imidoesters (such as dimethyl adipimidate HCL), active esters (such as disuccinimidyl suberate), aldehydes (such as glutareldehyde), bis-azido compounds (such as bis (p-azidobenzoyl) hexanediamine), bis-diazonium derivatives (such as bis-(p-diazoniumbenzoyl)-ethylenediamine), diisocyanates (such as tolyene 2,6-diisocyanate), and bis-active fluorine compounds (such as 1,5-difluoro-2,4-dinitrobenzene). For example, a ricin immunotoxin can be prepared as described in Vitetta et al., *Science*, 238: 1098 (1987). Carbon-14-labeled 1-isothiocyanatobenzyl-3-methyldiethylene triaminepentaacetic acid (MX-DTPA) is an exemplary chelating agent for conjugation of radionucleotide to the antibody. See WO94/11026.

In another embodiment, the antibody can be conjugated to a "receptor" (such streptavidin) for utilization in tumor pretargeting wherein the antibody-receptor conjugate is administered to the patient, followed by removal of unbound conjugate from the circulation using a clearing agent and then administration of a "ligand" (e.g., avidin) that is in turn conjugated to a cytotoxic agent.

Immunoliposomes

The antibodies disclosed herein can also be formulated as immunoliposomes. Liposomes containing the antibody are prepared by methods known in the art, such as described in Epstein et al., *Proc. Natl. Acad. Sci. USA*, 82: 3688 (1985); Hwang et al., *Proc. Natl. Acad. Sci. USA*, 77: 4030 (1980); and U.S. Pat. Nos. 4,485,045 and 4,544,545. Liposomes with enhanced circulation time are disclosed in U.S. Pat. No. 5,013,556.

Particularly useful liposomes can be generated by the reverse-phase evaporation method with a lipid composition comprising phosphatidylcholine, cholesterol, and PEG-derivatized phosphatidylethanolamine (PEG-PE). Liposomes are extruded through filters of defined pore size to yield liposomes with the desired diameter. Fab' fragments of the antibody of the present invention can be conjugated to the liposomes as described in Martin et al., *J. Biol. Chem.*, 257: 286–288 (1982) via a disulfide-interchange reaction. A chemotherapeutic agent (such as Doxorubicin) is optionally contained within the liposome. See Gabizon et al., *J. National Cancer Inst.*, 81(19): 1484 (1989).

Diagnostic Applications of Antibodies Directed Against the Proteins of the Invention Antibodies directed against a protein of the invention may be used in methods known within the art relating to the localization and/or quantitation of the protein (e.g., for use in measuring levels of the protein within appropriate physiological samples, for use in diagnostic methods, for use in imaging the protein, and the like). In a given embodiment, antibodies against the proteins, or derivatives, fragments, analogs or homologs thereof, that contain the antigen binding domain, are utilized as pharmacologically-active compounds (see below).

An antibody specific for a protein of the invention can be used to isolate the protein by standard techniques, such as immunoaffinity chromatography or immunoprecipitation. Such an antibody can facilitate the purification of the natural protein antigen from cells and of recombinantly produced antigen expressed in host cells. Moreover, such an antibody can be used to detect the antigenic protein (e.g., in a cellular lysate or cell supernatant) in order to evaluate the abundance and pattern of expression of the antigenic protein. Antibodies directed against the protein can be used diagnostically to monitor protein levels in tissue as part of a clinical testing procedure, e.g., to, for example, determine the efficacy of a given treatment regimen. Detection can be facilitated by coupling (i.e., physically linking) the antibody to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}$I, $^{131}$I, $^{35}$S or $^3$H.

Antibody Therapeutics

Antibodies of the invention, including polyclonal, monoclonal, humanized and fully human antibodies, may used as therapeutic agents. Such agents will generally be employed to treat or prevent a disease or pathology in a subject. An antibody preparation, preferably one having high specificity and high affinity for its target antigen, is administered to the subject and will generally have an effect due to its binding with the target. Such an effect may be one of two kinds, depending on the specific nature of the interaction between the given antibody molecule and the target antigen in question. In the first instance, administration of the antibody may abrogate or inhibit the binding of the target with an endogenous ligand to which it naturally binds. In this case, the antibody binds to the target and masks a binding site of the naturally occurring ligand, wherein the ligand serves as an effector molecule. Thus the receptor mediates a signal transduction pathway for which ligand is responsible.

Alternatively, the effect may be one in which the antibody elicits a physiological result by virtue of binding to an effector binding site on the target molecule. In this case the target, a receptor having an endogenous ligand which may be absent or defective in the disease or pathology, binds the antibody as a surrogate effector ligand, initiating a receptor-based signal transduction event by the receptor.

A therapeutically effective amount of an antibody of the invention relates generally to the amount needed to achieve a therapeutic objective. As noted above, this may be a binding interaction between the antibody and its target antigen that, in certain cases, interferes with the functioning of the target, and in other cases, promotes a physiological response. The amount required to be administered will furthermore depend on the binding affinity of the antibody for its specific antigen, and will also depend on the rate at which an administered antibody is depleted from the free volume other subject to which it is administered. Common ranges for therapeutically effective dosing of an antibody or antibody fragment of the invention may be, by way of nonlimiting example, from about 0.1 mg/kg body weight to about 50 mg/kg body weight. Common dosing frequencies may range, for example, from twice daily to once a week.

Pharmaceutical Compositions of Antibodies

Antibodies specifically binding a protein of the invention, as well as other molecules identified by the screening assays disclosed herein, can be administered for the treatment of various disorders in the form of pharmaceutical compositions. Principles and considerations involved in preparing such compositions, as well as guidance in the choice of components are provided, for example, in Remington: The Science And Practice Of Pharmacy 19th ed. (Alfonso R. Gennaro, et al., editors) Mack Pub. Co., Easton, Pa.: 1995; Drug Absorption Enhancement: Concepts, Possibilities, Limitations, And Trends, Harwood Academic Publishers, Langhorne, Pa., 1994; and Peptide And Protein Drug Delivery (Advances In Parenteral Sciences, Vol. 4), 1991, M. Dekker, New York.

If the antigenic protein is intracellular and whole antibodies are used as inhibitors, internalizing antibodies are preferred. However, liposomes can also be used to deliver the antibody, or an antibody fragment, into cells. Where antibody fragments are used, the smallest inhibitory fragment that specifically binds to the binding domain of the target protein is preferred. For example, based upon the variable-region sequences of an antibody, peptide molecules can be designed that retain the ability to bind the target protein sequence. Such peptides can be synthesized chemically and/or produced by recombinant DNA technology. See, e.g., Marasco et al., Proc. Natl. Acad. Sci. USA, 90: 7889–7893 (1993). The formulation herein can also contain more than one active compound as necessary for the particular indication being treated, preferably those with complementary activities that do not adversely affect each other. Alternatively, or in addition, the composition can comprise an agent that enhances its function, such as, for example, a cytotoxic agent, cytokine, chemotherapeutic agent, or growth-inhibitory agent. Such molecules are suitably present in combination in amounts that are effective for the purpose intended.

The active ingredients can also be entrapped in microcapsulesprepared, for example, by coacervation techniques or by interfacial polymerization, for example, hydroxymethylcellulose or gelatin-microcapsules and poly-(methylmethacrylate) microcapsules, respectively, in colloidal drug delivery systems (for example, liposomes, albumin microspheres, microemulsions, nano-particles, and nanocapsules) or in macroemulsions.

The formulations to be used for in vivo administration must be sterile. This is readily accomplished by filtration through sterile filtration membranes.

Sustained-release preparations can be prepared. Suitable examples of sustained-release preparations include semipermeable matrices of solid hydrophobic polymers containing the antibody, which matrices are in the form of shaped articles, e.g., films, or microcapsules. Examples of sustained-release matrices include polyesters, hydrogels (for example, poly(2-hydroxyethyl-methacrylate), or poly (vinylalcohol)), polylactides (U.S. Pat. No. 3,773,919), copolymers of L-glutamic acid and γ ethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), and poly-D-(−)-3-hydroxybutyric acid. While polymers such as ethylene-vinyl acetate and lactic acid-glycolic acid enable release of molecules for over 100 days, certain hydrogels release proteins for shorter time periods.

ELISA Assay

An agent for detecting an analyte protein is an antibody capable of binding to an analyte protein, preferably an antibody with a detectable label. Antibodies can be polyclonal, or more preferably, monoclonal. An intact antibody, or a fragment thereof (e.g., $F_{ab}$ or $F_{(ab)2}$) can be used. The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently-labeled secondary antibody and end-labeling of a DNA probe with biotin such that it can be detected with fluorescently-labeled streptavidin. The term "biological sample" is intended to include tissues, cells and biological fluids isolated from a subject, as well as tissues, cells and fluids present within a subject. Included within the usage of the term "biological sample", therefore, is blood and a fraction or component of blood including blood serum, blood plasma, or lymph. That is, the detection method of the invention can be used to detect an analyte mRNA, protein, or genomic DNA in a biological sample in vitro as well as in vivo. For example, in vitro techniques for detection of an analyte mRNA include Northern hybridizations and in situ hybridizations. In vitro techniques for detection of an analyte protein include enzyme linked immunosorbent assays (ELISAs), Western blots, immunoprecipitations, and immunofluorescence. In vitro techniques for detection of an analyte genomic DNA include Southern hybridizations. Procedures for conducting immunoassays are described, for example in "ELISA: Theory and Practice: Methods in Molecular Biology", Vol. 42, J. R. Crowther (Ed.) Human Press, Totowa, N.J., 1995; "Immunoassay", E. Diamandis and T. Christopoulus, Academic Press, Inc., San Diego, Calif., 1996; and "Practice and Thory of Enzyme Immunoassays", P. Tijssen, Elsevier Science Publishers, Amsterdam, 1985. Furthermore, in vivo techniques for detection of an analyte protein include introducing into a subject a labeled anti-an analyte protein antibody. For example, the antibody can be labeled with a radioactive marker whose presence and location in a subject can be detected by standard imaging techniques.

SECX and/or NOVX Recombinant Expression Vectors and Host Cells

Another aspect of the invention pertains to vectors, preferably expression vectors, containing a nucleic acid encoding an SECX and/or NOVX protein, or derivatives, fragments, analogs or homologs thereof. As used herein, the term "vector" refers to a nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors". In general, expression vectors of utility in recombinant DNA techniques are often in the form of plasmids. In the present specification, "plasmid" and "vector" can be used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

The recombinant expression vectors of the invention comprise a nucleic acid of the invention in a form suitable for expression of the nucleic acid in a host cell, which means that the recombinant expression vectors include one or more regulatory sequences, selected on the basis of the host cells to be used for expression, that is operatively-linked to the nucleic acid sequence to be expressed. Within a recombinant expression vector, "operably-linked" is intended to mean that the nucleotide sequence of interest is linked to the regulatory sequence(s) in a manner that allows for expression of the nucleotide sequence (e.g., in an in vitro transcription/translation system or in a host cell when the vector is introduced into the host cell).

The term "regulatory sequence" is intended to includes promoters, enhancers and other expression control elements (e.g., polyadenylation signals). Such regulatory sequences are described, for example, in Goeddel, GENE EXPRESSION TECHNOLOGY: METHODS IN ENZYMOLOGY 185, Academic Press, San Diego, Calif. (1990). Regulatory sequences include those that direct constitutive expression of a nucleotide sequence in many types of host cell and those that direct expression of the nucleotide sequence only in certain host cells (e.g., tissue-specific regulatory sequences). It will be appreciated by those skilled in the art that the design of the expression vector can depend on such factors as the choice of the host cell to be transformed, the level of expression of protein desired, etc. The expression vectors of the invention can be introduced into host cells to thereby produce proteins or peptides, including fusion proteins or peptides, encoded by nucleic acids as described herein (e.g., SECX and/or NOVX proteins, mutant forms of SECX and/or NOVX proteins, fusion proteins, etc.).

The recombinant expression vectors of the invention can be designed for expression of SECX and/or NOVX proteins in prokaryotic or eukaryotic cells. For example, SECX and/or NOVX proteins can be expressed in bacterial cells such as *Escherichia coli*, insect cells (using baculovirus expression vectors) yeast cells or mammalian cells. Suitable host cells are discussed further in Goeddel, GENE EXPRESSION TECHNOLOGY: METHODS IN ENZYMOLOGY 185, Academic Press, San Diego, Calif. (1990). Alternatively, the recombinant expression vector can be transcribed and translated in vitro, for example using T7 promoter regulatory sequences and T7 polymerase.

Expression of proteins in prokaryotes is most often carried out in *Escherichia coli* with vectors containing constitutive or inducible promoters directing the expression of either fusion or non-fusion proteins. Fusion vectors add a number of amino acids to a protein encoded therein, usually to the amino terminus of the recombinant protein. Such fusion vectors typically serve three purposes: (i) to increase expression of recombinant protein; (ii) to increase the solubility of the recombinant protein; and (iii) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Typical fusion expression vectors include pGEX (Pharmacia Biotech Inc; Smith and Johnson, 1988. *Gene* 67: 31–40), pMAL (New England Biolabs, Beverly, Mass.) and pRIT5 (Pharmacia, Piscataway, N.J.) that fuse glutathione S-transferase (GST), maltose E binding protein, or protein A, respectively, to the target recombinant protein.

Examples of suitable inducible non-fusion *E. coli* expression vectors include pTrc (Amrann et al., (1988) *Gene* 69:301–315) and pET 11d (Studier et al., GENE EXPRESSION TECHNOLOGY: METHODS IN ENZYMOLOGY 185, Academic Press, San Diego, Calif. (1990) 60–89).

One strategy to maximize recombinant protein expression in *E. coli* is to express the protein in a host bacteria with an impaired capacity to proteolytically cleave the recombinant protein. See, e.g., Gottesman, GENE EXPRESSION TECHNOLOGY: METHODS IN ENZYMOLOGY 185, Academic Press, San Diego, Calif. (1990) 119–128. Another strategy is to alter the nucleic acid sequence of the nucleic acid to be inserted into an expression vector so that the individual codons for each amino acid are those preferentially utilized in *E. coli* (see, e.g., Wada, et al., 1992. *Nucl. Acids Res.* 20: 2111–2118). Such alteration of nucleic acid sequences of the invention can be carried out by standard DNA synthesis techniques.

In another embodiment, the SECX and/or NOVX expression vector is a yeast expression vector. Examples of vectors for expression in yeast *Saccharomyces cerivisae* include pYepSec1 (Baldari, et al., 1987. *EMBO J.* 6: 229–234), pMFa (Kuijan and Herskowitz, 1982. *Cell* 30: 933–943), pJRY88 (Schultz et al., 1987. *Gene* 54: 113–123), pYES2 (Invitrogen Corporation, San Diego, Calif.), and picZ (InVitrogen Corp, San Diego, Calif.).

Alternatively, SECX and/or NOVX can be expressed in insect cells using baculovirus expression vectors. Baculovirus vectors available for expression of proteins in cultured insect cells (e.g., SF9 cells) include the pAc series (Smith, et al., 1983. *Mol. Cell. Biol.* 3: 2156–2165) and the pVL series (Lucklow and Summers, 1989. *Virology* 170: 31–39).

In yet another embodiment, a nucleic acid of the invention is expressed in mammalian cells using a mammalian expression vector. Examples of mammalian expression vectors include pCDM8 (Seed, 1987. *Nature* 329: 840) and pMT2PC (Kaufman, et al., 1987. *EMBO J.* 6: 187–195). When used in mammalian cells, the expression vector's control functions are often provided by viral regulatory elements. For example, commonly used promoters are derived from polyoma, adenovirus 2, cytomegalovirus, and simian virus 40. For other suitable expression systems for both prokaryotic and eukaryotic cells see, e.g., Chapters 16 and 17 of Sambrook, et al., MOLECULAR CLONING: A LABORATORY MANUAL. 2nd ed., Cold Spring Harbor Laboratory, Cold Spring Harbor Laboratory Press, Cold Spring Harbor, N.Y., 1989.

In another embodiment, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert, et al., 1987. *Genes Dev.* 1: 268–277), lymphoid-specific promoters (Calame and Eaton, 1988. *Adv. Immunol.* 43: 235–275), in particular promoters of T cell receptors (Winoto and Baltimore, 1989. *EMBO J.* 8: 729–733) and immunoglobulins (Banedji, et al., 1983. *Cell* 33: 729–740; Queen and Baltimore, 1983. *Cell* 33: 741–748), neuron-specific promoters (e.g., the neurofilament promoter; Byrne and Ruddle, 1989. *Proc. Natl. Acad. Sci. USA* 86: 5473–5477), pancreas-specific promoters (Edlund, et al., 1985. *Science* 230: 912–916), and mammary gland-specific promoters (e.g., milk whey promoter; U.S. Pat. No. 4,873, 316 and European Application Publication No. 264,166). Developmentally-regulated promoters are also encompassed, e.g., the murine hox promoters (Kessel and Gruss, 1990. *Science* 249: 374–379) and the α-fetoprotein promoter (Campes and Tilghman, 1989. *Genes Dev.* 3: 537–546).

The invention further provides a recombinant expression vector comprising a DNA molecule of the invention cloned into the expression vector in an antisense orientation. That is, the DNA molecule is operatively-linked to a regulatory sequence in a manner that allows for expression (by transcription of the DNA molecule) of an RNA molecule that is antisense to SECX and/or NOVX mRNA. Regulatory sequences operatively linked to a nucleic acid cloned in the antisense orientation can be chosen that direct the continuous expression of the antisense RNA molecule in a variety of cell types, for instance viral promoters and/or enhancers, or regulatory sequences can be chosen that direct constitutive, tissue specific or cell type specific expression of antisense RNA. The antisense expression vector can be in the form of a recombinant plasmid, phagemid or attenuated virus in which antisense nucleic acids are produced under the control of a high efficiency regulatory region, the activity of which can be determined by the cell type into which the vector is introduced. For a discussion of the regulation of gene expression using antisense genes see, e.g., Weintraub, et al., "Antisense RNA as a molecular tool for genetic analysis," *Reviews-Trends in Genetics*, Vol. 1(1) 1986.

Another aspect of the invention pertains to host cells into which a recombinant expression vector of the invention has been introduced. The terms "host cell" and "recombinant host cell" are used interchangeably herein. It is understood that such terms refer not only to the particular subject cell but also to the progeny or potential progeny of such a cell. Because certain modifications may occur in succeeding generations due to either mutation or environmental influences, such progeny may not, in fact, be identical to the parent cell, but are still included within the scope of the term as used herein.

A host cell can be any prokaryotic or eukaryotic cell. For example, SECX and/or NOVX protein can be expressed in bacterial cells such as *E. coli,* insect cells, yeast or mammalian cells (such as Chinese hamster ovary cells (CHO) or COS cells). Other suitable host cells are known to those skilled in the art.

Vector DNA can be introduced into prokaryotic or eukaryotic cells via conventional transformation or transfection techniques. As used herein, the terms "transformation" and "transfection" are intended to refer to a variety of art-recognized techniques for introducing foreign nucleic acid (e.g., DNA) into a host cell, including calcium phosphate or calcium chloride co-precipitation, DEAE-dextran-mediated transfection, lipofection, or electroporation. Suitable methods for transforming or transfecting host cells can be found in Sambrook, et al. (MOLECULAR CLONING: A LABORATORY MANUAL. 2nd ed., Cold Spring Harbor Laboratory, Cold Spring Harbor Laboratory Press, Cold Spring Harbor, N.Y., 1989), and other laboratory manuals.

For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., resistance to antibiotics) is generally introduced into the host cells along with the gene of interest. Various selectable markers include those that confer resistance to drugs, such as G418, hygromycin and methotrexate. Nucleic acid encoding a selectable marker can be introduced into a host cell on the same vector as that encoding SECX and/or NOVX or can be introduced on a separate vector. Cells stably transfected with the introduced nucleic acid can be identified by drug selection (e.g., cells that have incorporated the selectable marker gene will survive, while the other cells die).

A host cell of the invention, such as a prokaryotic or eukaryotic host cell in culture, can be used to produce (i.e., express) SECX and/or NOVX protein. Accordingly, the invention further provides methods for producing SECX and/or NOVX protein using the host cells of the invention. In one embodiment, the method comprises culturing the host cell of invention (into which a recombinant expression vector encoding SECX and/or NOVX protein has been introduced) in a suitable medium such that SECX and/or NOVX protein is produced. In another embodiment, the method further comprises isolating SECX and/or NOVX protein from the medium or the host cell.

Transgenic SECX and/or NOVX Animals

The host cells of the invention can also be used to produce non-human transgenic animals. For example, in one embodiment, a host cell of the invention is a fertilized oocyte or an embryonic stem cell into which SECX and/or NOVX protein-coding sequences have been introduced. Such host cells can then be used to create non-human transgenic animals in which exogenous SECX and/or NOVX sequences have been introduced into their genome or homologous recombinant animals in which endogenous SECX and/or NOVX sequences have been altered. Such animals are useful for studying the function and/or activity of SECX and/or NOVX protein and for identifying and/or evaluating modulators of SECX and/or NOVX protein activity. As used herein, a "transgenic animal" is a non-human animal, preferably a mammal, more preferably a rodent such as a rat or mouse, in which one or more of the cells of the animal includes a transgene. Other examples of transgenic animals include non-human primates, sheep, dogs, cows, goats, chickens, amphibians, etc. A transgene is exogenous DNA that is integrated into the genome of a cell from which a transgenic animal develops and that remains in the genome of the mature animal, thereby directing the expression of an encoded gene product in one or more cell types or tissues of the transgenic animal. As used herein, a "homologous recombinant animal" is a non-human animal, preferably a mammal, more preferably a mouse, in which an endogenous SECX and/or NOVX gene has been altered by homologous recombination between the endogenous gene and an exogenous DNA molecule introduced into a cell of the animal, e.g., an embryonic cell of the animal, prior to development of the animal.

A transgenic animal of the invention can be created by introducing SECX and/or NOVX-encoding nucleic acid into the male pronuclei of a fertilized oocyte (e.g., by microinjection, retroviral infection) and allowing the oocyte to develop in a pseudopregnant female foster animal. The human SECX and/or NOVX cDNA sequences SEQ ID NOS:1, 3, 5, 7, 9, 11, 13, 15, 17, 19, 21, 23, 25, 27, 29, 31, 33, 35, 37, 39 and 319 can be introduced as a transgene into the genome of a non-human animal. Alternatively, a non-human homologue of the human SECX and/or NOVX gene, such as a mouse SECX and/or NOVX gene, can be isolated based on hybridization to the human SECX and/or NOVX cDNA (described further supra) and used as a transgene. Intronic sequences and polyadenylation signals can also be included in the transgene to increase the efficiency of expression of the transgene. A tissue-specific regulatory sequence(s) can be operably-linked to the SECX and/or NOVX transgene to direct expression of SECX and/or NOVX protein to particular cells. Methods for generating transgenic animals via embryo manipulation and microinjection, particularly animals such as mice, have become conventional in the art and are described, for example, in U.S. Pat. Nos. 4,736,866; 4,870,009; and 4,873,191; and Hogan, 1986. In: MANIPULATING THE MOUSE EMBRYO, Cold Spring Harbor Laboratory Press, Cold Spring Harbor, N.Y. Similar methods are used for production of other transgenic animals. A transgenic founder animal can be identified based upon the presence of the SECX and/or NOVX transgene in its genome and/or expression of SECX and/or NOVX mRNA in tissues or cells of the animals. A transgenic founder animal can then be used to breed additional animals carrying the transgene. Moreover, transgenic animals carrying a transgene-encoding SECX and/or NOVX protein can further be bred to other transgenic animals carrying other transgenes.

To create a homologous recombinant animal, a vector is prepared which contains at least a portion of an SECX and/or NOVX gene into which a deletion, addition or substitution has been introduced to thereby alter, e.g., functionally disrupt, the SECX and/or NOVX gene. The SECX and/or NOVX gene can be a human gene (e.g., the cDNA of SEQ ID NOS:1, 3, 5, 7, 9, 11, 13, 15, 17, 19, 21, 23, 25, 27, 29, 31, 33, 35, 37, 39 and 319), but more preferably, is a non-human homologue of a human SECX and/or NOVX gene. For example, a mouse homologue of human SECX and/or NOVX gene of SEQ ID NOS:1, 3, 5, 7, 9, 11, 13, 15, 17, 19, 21, 23, 25, 27, 29, 31, 33, 35, 37, 39 and 319 can be used to construct a homologous recombination vector suitable for altering an endogenous SECX and/or NOVX gene in the mouse genome. In one embodiment, the vector is designed such that, upon homologous recombination, the endogenous SECX and/or NOVX gene is functionally disrupted (i.e., no longer encodes a functional protein; also referred to as a "knock out" vector).

Alternatively, the vector can be designed such that, upon homologous recombination, the endogenous SECX and/or NOVX gene is mutated or otherwise altered but still encodes functional protein (e.g., the upstream regulatory region can be altered to thereby alter the expression of the endogenous SECX and/or NOVX protein). In the homologous recombination vector, the altered portion of the SECX and/or NOVX gene is flanked at its 5'- and 3'-termini by additional nucleic acid of the SECX and/or NOVX gene to allow for homologous recombination to occur between the exogenous SECX and/or NOVX gene carried by the vector and an endogenous SECX and/or NOVX gene in an embryonic stem cell. The additional flanking SECX and/or NOVX nucleic acid is of sufficient length for successful homologous recombination with the endogenous gene. Typically, several kilobases of flanking DNA (both at the 5'- and 3'-termini) are included in the vector. See, e.g., Thomas, et al., 1987. *Cell* 51: 503 for a description of homologous recombination vectors. The vector is ten introduced into an embryonic stem cell line (e.g., by electroporation) and cells in which the introduced SECX and/or NOVX gene has homologously-recombined with the endogenous SECX and/or NOVX gene are selected. See, e.g., Li, et al., 1992. *Cell* 69: 915.

The selected cells are then injected into a blastocyst of an animal (e.g., a mouse) to form aggregation chimeras. See, e.g., Bradley, 1987. In: TERATOCARCINOMAS AND EMBRYONIC STEM CELLS: A PRACTICAL APPROACH, Robertson, ed. IRL, Oxford, pp. 113–152. A chimeric embryo can then be implanted into a suitable pseudopregnant female foster animal and the embryo brought to term. Progeny harboring the homologously-recombined DNA in their germ cells can be used to breed animals in which all cells of the animal contain the homologously-recombined DNA by germline transmission of the transgene. Methods for constructing homologous recombination vectors and homologous recombinant animals are described further in Bradley, 1991. *Curr. Opin. Biotechnol.* 2: 823–829; PCT International Publication Nos.: WO 90/11354; WO 91/01140; WO 92/0968; and WO 93/04169.

In another embodiment, transgenic non-humans animals can be produced that contain selected systems that allow for regulated expression of the transgene. One example of such a system is the cre/loxP recombinase system of bacteriophage P1. For a description of the cre/loxP recombinase system, See, e.g., Lakso, et al., 1992. *Proc. Natl. Acad. Sci. USA* 89: 6232–6236. Another example of a recombinase system is the FLP recombinase system of *Saccharomyces cerevisiae*. See, O'Gorman, et al., 1991. *Science* 251:1351–1355. If a cre/loxP recombinase system is used to regulate expression of the transgene, animals containing transgenes encoding both the Cre recombinase and a selected protein are required. Such animals can be provided through the construction of "double" transgenic animals, e.g., by mating two transgenic animals, one containing a transgene encoding a selected protein and the other containing a transgene encoding a recombinase.

Clones of the non-human transgenic animals described herein can also be produced according to the methods described in Wilmut, et al., 1997. *Nature* 385: 810–813. In brief, a cell (e.g., a somatic cell) from the transgenic animal can be isolated and induced to exit the growth cycle and enter Go phase. The quiescent cell can then be fused, e.g., through the use of electrical pulses, to an enucleated oocyte from an animal of the same species from which the quiescent cell is isolated. The reconstructed oocyte is then cultured such that it develops to morula or blastocyte and then transferred to pseudopregnant female foster animal. The offspring borne of this female foster animal will be a clone of the animal from which the cell (e.g., the somatic cell) is isolated.

Pharmaceutical Compositions

The SECX and/or NOVX nucleic acid molecules, SECX and/or NOVX proteins, and anti-SECX and/or NOVX antibodies (also referred to herein as "active compounds") of the invention, and derivatives, fragments, analogs and homologs thereof, can be incorporated into pharmaceutical compositions suitable for administration. Such compositions typically comprise the nucleic acid molecule, protein, or antibody and a pharmaceutically acceptable carrier. As used herein, "pharmaceutically acceptable carrier" is intended to include any and all solvents, dispersion media, coatings, antibacterial and antifungal agents, isotonic and absorption delaying agents, and the like, compatible with pharmaceutical administration. Suitable carriers are described in the most recent edition of Remington's Pharmaceutical Sciences, a standard reference text in the field, which is incorporated herein by reference. Preferred examples of such carriers or diluents include, but are not limited to, water, saline, finger's solutions, dextrose solution, and 5% human serum albumin. Liposomes and non-aqueous vehicles such as fixed oils may also be used. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

A pharmaceutical composition of the invention is formulated to be compatible with its intended route of administration. Examples of routes of administration include parenteral, e.g., intravenous, intradermal, subcutaneous, oral (e.g., inhalation), transdermal (i.e., topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid (EDTA); buffers such as acetates, citrates or phosphates, and agents for the adjustment of tonicity such as sodium chloride or dextrose. The pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL (BASF, Parsippany, N.J.) or phosphate buffered saline (PBS). In all cases, the composition must be sterile and should be fluid to the extent that easy syringeability exists. It must be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as manitol, sorbitol, sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound (e.g., an SECX and/or NOVX protein or anti-SECX and/or NOVX antibody) in the required amount in an appropriate solvent with one or a combination of ingredients enumerated above, as required, followed by filtered sterilization. Generally, dispersions are prepared by incorporating the active compound into a sterile vehicle that contains a basic dispersion medium and the required other ingredients from those enumerated above. In the case of sterile powders for the preparation of sterile injectable solutions, methods of preparation are vacuum drying and freeze-drying that yields a powder of the active ingredient plus any additional desired ingredient from a previously sterile-filtered solution thereof.

Oral compositions generally include an inert diluent or an edible carrier. They can be enclosed in gelatin capsules or compressed into tablets. For the purpose of oral therapeutic administration, the active compound can be incorporated with excipients and used in the form of tablets, troches, or capsules. Oral compositions can also be prepared using a fluid carrier for use as a mouthwash, wherein the compound in the fluid carrier is applied orally and swished and expectorated or swallowed. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from pressured container or dispenser which contains a suitable propellant, e.g., a gas such as carbon dioxide, or a nebulizer.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. The materials can also be obtained commercially from Alza Corporation and Nova Pharmaceuticals, Inc. Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

It is especially advantageous to formulate oral or parenteral compositions in dosage unit form for ease of administration and uniformity of dosage. Dosage unit form as used herein refers to physically discrete units suited as unitary dosages for the subject to be treated; each unit containing a predetermined quantity of active compound calculated to produce the desired therapeutic effect in association with the required pharmaceutical carrier. The specification for the dosage unit forms of the invention are dictated by and directly dependent on the unique characteristics of the active compound and the particular therapeutic effect to be achieved, and the limitations inherent in the art of compounding such an active compound for the treatment of individuals.

The nucleic acid molecules of the invention can be inserted into vectors and used as gene therapy vectors. Gene therapy vectors can be delivered to a subject by, for example, intravenous injection, local administration (see, e.g., U.S. Pat. No. 5,328,470) or by stereotactic injection (see, e.g., Chen, et al., 1994. *Proc. Natl. Acad. Sci. USA* 91: 3054–3057). The pharmaceutical preparation of the gene therapy vector can include the gene therapy vector in an acceptable diluent, or can comprise a slow release matrix in which the gene delivery vehicle is imbedded. Alternatively, where the complete gene delivery vector can be produced intact from recombinant cells, e.g., retroviral vectors, the pharmaceutical preparation can include one or more cells that produce the gene delivery system.

The pharmaceutical compositions can be included in a container, pack, or dispenser together with instructions for administration.

Screening and Detection Methods

The isolated nucleic acid molecules of the invention can be used to express SECX and/or NOVX protein (e.g., via a recombinant expression vector in a host cell in gene therapy applications), to detect SECX and/or NOVX mRNA (e.g., in a biological sample) or a genetic lesion in an SECX and/or NOVX gene, and to modulate SECX and/or NOVX activity, as described further, below. In addition, the SECX and/or NOVX proteins can be used to screen drugs or compounds that modulate the SECX and/or NOVX protein activity or expression as well as to treat disorders characterized by insufficient or excessive production of SECX and/or NOVX protein or production of SECX and/or NOVX protein forms that have decreased or aberrant activity compared to SECX and/or NOVX wild-type protein (e.g.; diabetes (regulates insulin release); obesity (binds and transport lipids); metabolic disturbances associated with obesity, the metabolic syndrome X as well as anorexia and wasting disorders associated with chronic diseases and various cancers, and infectious disease (possesses anti-microbial activity) and the various dyslipidemias. In addition, the anti-SECX and/or NOVX antibodies of the invention can be used to detect and isolate SECX and/or NOVX proteins and modulate SECX and/or NOVX activity. In yet a further aspect, the invention can be used in methods to influence appetite, absorption of nutrients and the disposition of metabolic substrates in both a positive and negative fashion.

The invention further pertains to novel agents identified by the screening assays described herein and uses thereof for treatments as described, supra.

Screening Assays

The invention provides a method (also referred to herein as a "screening assay") for identifying modulators, i.e., candidate or test compounds or agents (e.g., peptides, peptidomimetics, small molecules or other drugs) that bind to SECX and/or NOVX proteins or have a stimulatory or inhibitory effect on, e.g., SECX and/or NOVX protein expression or SECX and/or NOVX protein activity. The invention also includes compounds identified in the screening assays described herein.

In one embodiment, the invention provides assays for screening candidate or test compounds which bind to or modulate the activity of the membrane-bound form of an SECX and/or NOVX protein or polypeptide or biologically-active portion thereof. The test compounds of the invention can be obtained using any of the numerous approaches in combinatorial library methods known in the art, including: biological libraries; spatially addressable parallel solid phase or solution phase libraries; synthetic library methods requiring deconvolution; the "one-bead one-compound" library method; and synthetic library methods using affinity chromatography selection. The biological library approach is limited to peptide libraries, while the other four approaches are applicable to peptide, non-peptide oligomer or small molecule libraries of compounds. See, e.g., Lam, 1997. *Anticancer Drug Design* 12: 145.

A "small molecule" as used herein, is meant to refer to a composition that has a molecular weight of less than about 5 kD and most preferably less than about 4 kD. Small molecules can be, e.g., nucleic acids, peptides, polypeptides, peptidomimetics, carbohydrates, lipids or other organic or inorganic molecules. Libraries of chemical and/or biological mixtures, such as fungal, bacterial, or algal extracts, are known in the art and can be screened with any of the assays of the invention.

Examples of methods for the synthesis of molecular libraries can be found in the art, for example in: DeWitt, et al., 1993. *Proc. Natl. Acad. Sci. U.S.A.* 90: 6909; Erb, et al., 1994. *Proc. Natl. Acad. Sci. U.S.A.* 91: 11422; Zuckermann, et al., 1994. *J. Med. Chem.* 37: 2678; Cho, et al., 1993. *Science* 261: 1303; Carrell, et al., 1994. *Angew. Chem. Int. Ed. Engl.* 33: 2059; Carell, et al., 1994. *Angew. Chem. Imt. Ed. Engl.* 33: 2061; and Gallop, et al., 1994. *J. Med. Chem.* 37:1233.

Libraries of compounds may be presented in solution (e.g., Houghten, 1992. *Biotechniques* 13: 412–421), or on beads (Lam, 1991. *Nature* 354: 82–84), on chips (Fodor, 1993. *Nature* 364: 555–556), bacteria (Ladner, U.S. Pat. No. 5,223,409), spores (Ladner, U.S. Pat. No. 5,233,409), plasmids (Cull, et al., 1992. *Proc. Natl. Acad. Sci. USA* 89: 1865–1869) or on phage (Scott and Smith, 1990. *Science* 249: 386–390; Devlin, 1990. *Science* 249: 404–406; Cwirla, et al., 1990. *Proc. Natl. Acad. Sci. U.S.A.* 87: 6378–6382; Felici, 1991. *J. Mol. Biol.* 222: 301–310; Ladner, U.S. Pat. No. 5,233,409.).

In one embodiment, an assay is a cell-based assay in which a cell which expresses a membrane-bound form of SECX and/or NOVX protein, or a biologically-active portion thereof, on the cell surface is contacted with a test compound and the ability of the test compound to bind to an SECX and/or NOVX protein determined. The cell, for example, can of mammalian origin or a yeast cell. Determining the ability of the test compound to bind to the SECX and/or NOVX protein can be accomplished, for example, by coupling the test compound with a radioisotope or enzymatic label such that binding of the test compound to the SECX and/or NOVX protein or biologically-active portion thereof can be determined by detecting the labeled compound in a complex. For example, test compounds can be labeled with $^{125}I$, $^{35}S$, $^{14}C$, or $^{3}H$, either directly or indirectly, and the radioisotope detected by direct counting of radioemission or by scintillation counting. Alternatively, test compounds can be enzymatically-labeled with, for example, horseradish peroxidase, alkaline phosphatase, or luciferase, and the enzymatic label detected by determination of conversion of an appropriate substrate to product. In one embodiment, the assay comprises contacting a cell which expresses a membrane-bound form of SECX and/or NOVX protein, or a biologically-active portion thereof, on the cell surface with a known compound which binds SECX and/or NOVX to form an assay mixture, contacting the assay mixture with a test compound, and determining the ability of the test compound to interact with an SECX and/or NOVX protein, wherein determining the ability of the test compound to interact with an SECX and/or NOVX protein comprises determining the ability of the test compound to preferentially bind to SECX and/or NOVX protein or a biologically-active portion thereof as compared to the known compound.

In another embodiment, an assay is a cell-based assay comprising contacting a cell expressing a membrane-bound form of SECX and/or NOVX protein, or a biologically-active portion thereof, on the cell surface with a test compound and determining the ability of the test compound to modulate (e.g., stimulate or inhibit) the activity of the SECX and/or NOVX protein or biologically-active portion thereof. Determining the ability of the test compound to modulate the activity of SECX and/or NOVX or a biologically-active portion thereof can be accomplished, for example, by determining the ability of the SECX and/or NOVX protein to bind to or interact with an SECX and/or NOVX target molecule. As used herein, a "target molecule" is a molecule with which an SECX and/or NOVX protein binds or interacts in nature, for example, a molecule on the surface of a cell which expresses an SECX and/or NOVX interacting protein, a molecule on the surface of a second cell, a molecule in the extracellular milieu, a molecule associated with the internal surface of a cell membrane or a cytoplasmic molecule. An SECX and/or NOVX target molecule can be a non-SECX and/or NOVX molecule or an SECX and/or NOVX protein or polypeptide of the invention. In one embodiment, an SECX and/or NOVX target molecule is a component of a signal transduction pathway that facilitates transduction of an extracellular signal (e.g. a signal generated by binding of a compound to a membrane-bound SECX and/or NOVX molecule) through the cell membrane and into the cell. The target, for example, can be a second intercellular protein that has catalytic activity or a protein that facilitates the association of downstream signaling molecules with SECX and/or NOVX.

Determining the ability of the SECX and/or NOVX protein to bind to or interact with an SECX and/or NOVX target molecule can be accomplished by one of the methods described above for determining direct binding. In one embodiment, determining the ability of the SECX and/or NOVX protein to bind to or interact with an SECX and/or NOVX target molecule can be accomplished by determining the activity of the target molecule. For example, the activity of the target molecule can be determined by detecting induction of a cellular second messenger of the target (i.e. intracellular $Ca^{2+}$, diacylglycerol, $IP_3$, etc.), detecting catalytic/enzymatic activity of the target an appropriate substrate, detecting the induction of a reporter gene (comprising an SECX and/or NOVX-responsive regulatory element operatively linked to a nucleic acid encoding a detectable marker, e.g., luciferase), or detecting a cellular response, for example, cell survival, cellular differentiation, or cell proliferation.

In yet another embodiment, an assay of the invention is a cell-free assay comprising contacting an SECX and/or NOVX protein or biologically-active portion thereof with a test compound and determining the ability of the test compound to bind to the SECX and/or NOVX protein or biologically-active portion thereof. Binding of the test compound to the SECX and/or NOVX protein can be determined either directly or indirectly as described above. In one such embodiment, the assay comprises contacting the SECX and/or NOVX protein or biologically-active portion thereof with a known compound which binds SECX and/or NOVX to form an assay mixture, contacting the assay mixture with a test compound, and determining the ability of the test compound to interact with an SECX and/or NOVX protein, wherein determining the ability of the test compound to interact with an SECX and/or NOVX protein comprises determining the ability of the test compound to preferentially bind to SECX and/or NOVX or biologically-active portion thereof as compared to the known compound.

In still another embodiment, an assay is a cell-free assay comprising contacting SECX and/or NOVX protein or biologically-active portion thereof with a test compound and determining the ability of the test compound to modulate (e.g. stimulate or inhibit) the activity of the SECX and/or NOVX protein or biologically-active portion thereof. Determining the ability of the test compound to modulate the activity of SECX and/or NOVX can be accomplished, for example, by determining the ability of the SECX and/or NOVX protein to bind to an SECX and/or NOVX target molecule by one of the methods described above for determining direct binding. In an alternative embodiment, determining the ability of the test compound to modulate the activity of SECX and/or NOVX protein can be accomplished by determining the ability of the SECX and/or NOVX protein further modulate an SECX and/or NOVX target molecule. For example, the catalytic/enzymatic activity of the target molecule on an appropriate substrate can be determined as described, supra.

In yet another embodiment, the cell-free assay comprises contacting the SECX and/or NOVX protein or biologically-active portion thereof with a known compound which binds SECX and/or NOVX protein to form an assay mixture, contacting the assay mixture with a test compound, and determining the ability of the test compound to interact with an SECX and/or NOVX protein, wherein determining the ability of the test compound to interact with an SECX and/or NOVX protein comprises determining the ability of the SECX and/or NOVX protein to preferentially bind to or modulate the activity of an SECX and/or NOVX target molecule.

The cell-free assays of the invention are amenable to use of both the soluble form or the membrane-bound form of SECX and/or NOVX protein. In the case of cell-free assays comprising the membrane-bound form of SECX and/or NOVX protein, it may be desirable to utilize a solubilizing agent such that the membrane-bound form of SECX and/or NOVX protein is maintained in solution. Examples of such solubilizing agents include non-ionic detergents such as n-octylglucoside, n-dodecylglucoside, n-dodecylmaltoside, octanoyl-N-methylglucamide, decanoyl-N-methylglucamide, Tritons X-100, Triton® X-114, Thesit®, Isotridecypoly(ethylene glycol ether)$_n$, N-dodecyl-N,N-dimethyl-3-ammonio-1-propane sulfonate, 3-(3-cholamidopropyl) dimethylamminiol-1-propane sulfonate (CHAPS), or 3-(3-cholamidopropyl)dimethylamminiol-2-hydroxy-1-propane sulfonate (CHAPSO).

In more than one embodiment of the above assay methods of the invention, it may be desirable to immobilize either SECX and/or NOVX protein or its target molecule to facilitate separation of complexed from uncomplexed forms of one or both of the proteins, as well as to accommodate automation of the assay. Binding of a test compound to SECX and/or NOVX protein, or interaction of SECX and/or NOVX protein with a target molecule in the presence and absence of a candidate compound, can be accomplished in any vessel suitable for containing the reactants. Examples of such vessels include microtiter plates, test tubes, and microcentrifuge tubes. In one embodiment, a fusion protein can be provided that adds a domain that allows one or both of the proteins to be bound to a matrix. For example, GST-SECX and/or NOVX fusion proteins or GST-target fusion proteins can be adsorbed onto glutathione sepharose beads (Sigma Chemical, St. Louis, Mo.) or glutathione derivatized microtiter plates, that are then combined with the test compound or the test compound and either the non-adsorbed target protein or SECX and/or NOVX protein, and the mixture is incubated under conditions conducive to complex formation (e.g., at physiological conditions for salt and pH). Following incubation, the beads or microtiter plate wells are washed to remove any unbound components, the matrix immobilized in the case of beads, complex determined either directly or indirectly, for example, as described, supra. Alternatively, the complexes can be dissociated from the matrix, and the level of SECX and/or NOVX protein binding or activity determined using standard techniques.

Other techniques for immobilizing proteins on matrices can also be used in the screening assays of the invention. For example, either the SECX and/or NOVX protein or its target molecule can be immobilized utilizing conjugation of biotin and streptavidin. Biotinylated SECX and/or NOVX protein or target molecules can be prepared from biotin-NHS(N-hydroxy-succinimide) using techniques well-known within the art (e.g., biotinylation kit, Pierce Chemicals, Rockford, Ill.), and immobilized in the wells of streptavidin-coated 96 well plates (Pierce Chemical). Alternatively, antibodies reactive with SECX and/or NOVX protein or target molecules, but which do not interfere with binding of the SECX and/or NOVX protein to its target molecule, can be derivatized to the wells of the plate, and unbound target or SECX and/or NOVX protein trapped in the wells by antibody conjugation. Methods for detecting such complexes, in addition to those described above for the GST-immobilized complexes, include immunodetection of complexes using antibodies reactive with the SECX and/or NOVX protein or target molecule, as well as enzyme-linked assays that rely on detecting an enzymatic activity associated with the SECX and/or NOVX protein or target molecule.

In another embodiment, modulators of SECX and/or NOVX protein expression are identified in a method wherein a cell is contacted with a candidate compound and the expression of SECX and/or NOVX mRNA or protein in the cell is determined. The level of expression of SECX and/or NOVX mRNA or protein in the presence of the candidate compound is compared to the level of expression of SECX and/or NOVX mRNA or protein in the absence of the candidate compound. The candidate compound can then be identified as a modulator of SECX and/or NOVX mRNA or protein expression based upon this comparison. For example, when expression of SECX and/or NOVX mRNA or protein is greater (i.e., statistically significantly greater) in the presence of the candidate compound than in its absence, the candidate compound is identified as a stimulator of SECX and/or NOVX mRNA or protein expression. Alternatively, when expression of SECX and/or NOVX mRNA or protein is less (statistically significantly less) in the presence of the candidate compound than in its absence, the candidate compound is identified as an inhibitor of SECX and/or NOVX mRNA or protein expression. The level of SECX and/or NOVX mRNA or protein expression in the cells can be determined by methods described herein for detecting SECX and/or NOVX mRNA or protein.

In yet another aspect of the invention, the SECX and/or NOVX proteins can be used as "bait proteins" in a two-hybrid assay or three hybrid assay (see, e.g., U.S. Pat. No. 5,283,317; Zervos, et al., 1993. *Cell* 72: 223–232; Madura, et al., 1993. *J. Biol. Clhem.* 268: 12046–12054; Bartel, et al., 1993. *Biotechniques* 14: 920–924; Iwabuchi, et al., 1993. *Oncogene* 8: 1693–1696; and Brent WO 94/10300), to identify other proteins that bind to or interact with SECX and/or NOVX ("SECX and/or NOVX-binding proteins" or "SECX and/or NOVX-bp") and modulate SECX and/or NOVX activity. Such SECX and/or NOVX-binding proteins are also likely to be involved in the propagation of signals by the SECX and/or NOVX proteins as, for example, upstream or downstream elements of the SECX and/or NOVX pathway.

The two-hybrid system is based on the modular nature of most transcription factors, which consist of separable DNA-binding and activation domains. Briefly, the assay utilizes two different DNA constructs. In one construct, the gene that codes for SECX and/or NOVX is fused to a gene encoding the DNA binding domain of a known transcription factor (e.g., GAL-4). In the other construct, a DNA sequence, from a library of DNA sequences, that encodes an unidentified protein ("prey" or "sample") is fused to a gene that codes for the activation domain of the known transcription factor. If the "bait" and the "prey" proteins are able to interact, in vivo, forming an SECX and/or NOVX-dependent complex, the DNA-binding and activation domains of the transcription factor are brought into close proximity. This proximity allows transcription of a reporter gene (e.g., LacZ) that is operably linked to a transcriptional regulatory site responsive to the transcription factor. Expression of the reporter gene can be detected and cell colonies containing the functional transcription factor can be isolated and used to obtain the cloned gene that encodes the protein which interacts with SECX and/or NOVX.

The invention further pertains to novel agents identified by the aforementioned screening assays and uses thereof for treatments as described herein.

Detection Assays

Portions or fragments of the cDNA sequences identified herein (and the corresponding complete gene sequences) can be used in numerous ways as polynucleotide reagents. By way of example, and not of limitation, these sequences can be used to: (i) map their respective genes on a chromosome; and, thus, locate gene regions associated with genetic disease; (ii) identify an individual from a minute biological sample (tissue typing); and (iii) aid in forensic identification of a biological sample. Some of these applications are described in the subsections, below.

Chromosome Mapping

Once the sequence (or a portion of the sequence) of a gene has been isolated, this sequence can be used to map the location of the gene on a chromosome. This process is called chromosome mapping. Accordingly, portions or fragments of the SECX and/or NOVX sequences, SEQ ID NOS:1, 3, 5, 7, 9, 11, 13, 15, 17, 19, 21, 23, 25, 27, 29, 31, 33, 35, 37, 39 and 319, or fragments or derivatives thereof, can be used to map the location of the SECX and/or NOVX genes, respectively, on a chromosome. The mapping of the SECX and/or NOVX sequences to chromosomes is an important first step in correlating these sequences with genes associated with disease.

Briefly, SECX and/or NOVX genes can be mapped to chromosomes by preparing PCR primers (preferably 15–25 bp in length) from the SECX and/or NOVX sequences. Computer analysis of the SECX and/or NOVX, sequences can be used to rapidly select primers that do not span more than one exon in the genomic DNA, thus complicating the amplification process. These primers can then be used for PCR screening of somatic cell hybrids containing individual human chromosomes. Only those hybrids containing the human gene corresponding to the SECX and/or NOVX sequences will yield an amplified fragment.

Somatic cell hybrids are prepared by fusing somatic cells from different mammals (e.g., human and mouse cells). As hybrids of human and mouse cells grow and divide, they gradually lose human chromosomes in random order, but retain the mouse chromosomes. By using media in which mouse cells cannot grow, because they lack a particular enzyme, but in which human cells can, the one human chromosome that contains the gene encoding the needed enzyme will be retained. By using various media, panels of hybrid cell lines can be established. Each cell line in a panel contains either a single human chromosome or a small number of human chromosomes, and a full set of mouse chromosomes, allowing easy mapping of individual genes to specific human chromosomes. See, e.g., D'Eustachio, el al., 1983. Science 220: 919–924. Somatic cell hybrids containing only fragments of human chromosomes can also be produced by using human chromosomes with translocations and deletions.

PCR mapping of somatic cell hybrids is a rapid procedure for assigning a particular sequence to a particular chromosome. Three or more sequences can be assigned per day using a single thermal cycler. Using the SECX and/or NOVX sequences to design oligonucleotide primers, sublocalization can be achieved with panels of fragments from specific chromosomes.

Fluorescence in situ hybridization (FISH) of a DNA sequence to a metaphase chromosomal spread can further be used to provide a precise chromosomal location in one step. Chromosome spreads can be made using cells whose division has been blocked in metaphase by a chemical like colcemid that disrupts the mitotic spindle. The chromosomes can be treated briefly with trypsin, and then stained with Giemsa. A pattern of light and dark bands develops on each chromosome, so that the chromosomes can be identified individually. The FISH technique can be used with a DNA sequence as short as 500 or 600 bases. However, clones larger than 1,000 bases have a higher likelihood of binding to a unique chromosomal location with sufficient signal intensity for simple detection. Preferably 1,000 bases, and more preferably 2,000 bases, will suffice to get good results at a reasonable amount of time. For a review of this technique, see, Verma, et al., HUMAN CHROMOSOMES: A MANUAL OF BASIC TECHNIQUES (Pergamon Press, New York 1988).

Reagents for chromosome mapping can be used individually to mark a single chromosome or a single site on that chromosome, or panels of reagents can be used for marking multiple sites and/or multiple chromosomes. Reagents corresponding to noncoding regions of the genes actually are preferred for mapping purposes. Coding sequences are more likely to be conserved within gene families, thus increasing the chance of cross hybridizations during chromosomal mapping.

Once a sequence has been mapped to a precise chromosomal location, the physical. position of the sequence on the chromosome can be correlated with genetic map data. Such data are found, e.g., in McKusick, MENDELIAN INHERITANCE IN MAN, available on-line through Johns Hopkins University Welch Medical Library). The relationship between genes and disease, mapped to the same chromosomal region, can then be identified through linkage analysis (co-inheritance of physically adjacent genes), described in, e.g., Egeland, et al., 1987. Nature, 325: 783–787.

Moreover, differences in the DNA sequences between individuals affected and unaffected with a disease associated with the SECX and/or NOVX gene, can be determined. If a mutation is observed in some or all of the affected individuals but not in any unaffected individuals, then the mutation is likely to be the causative agent of the particular disease. Comparison of affected and unaffected individuals generally involves first looking for structural alterations in the chromosomes, such as deletions or translocations that are visible from chromosome spreads or detectable using PCR based on that DNA sequence. Ultimately, complete sequencing of genes from several individuals can be performed to confirm the presence of a mutation and to distinguish mutations from polymorphisms.

Tissue Typing

The SECX and/or NOVX sequences of the invention can also be used to identify individuals from minute biological samples. In this technique, an individual's genomic DNA is digested with one or more restriction enzymes, and probed on a Southern blot to yield unique bands for identification. The sequences of the invention are useful as additional DNA markers for RFLP ("restriction fragment length polymorphisms," described in U.S. Pat. No. 5,272,057).

Furthermore, the sequences of the invention can be used to provide an alternative technique that determines the actual base-by-base DNA sequence of selected portions of an individual's genome. Thus, the SECX and/or NOVX sequences described herein can be used to prepare two PCR primers from the 5'- and 3'-termini of the sequences. These primers can then be used to amplify an individual's DNA and subsequently sequence it.

Panels of corresponding DNA sequences from individuals, prepared in this manner, can provide unique individual identifications, as each individual will have a unique set of such DNA sequences due to allelic differences. The sequences of the invention can be used to obtain such identification sequences from individuals and from tissue. The SECX and/or NOVX sequences of the invention uniquely represent portions of the human genome. Allelic variation occurs to some degree in the coding regions of these sequences, and to a greater degree in the noncoding regions. It is estimated that allelic variation between individual humans occurs with a frequency of about once per each 500 bases. Much of the allelic variation is due to single nucleotide polymorphisms (SNPs), which include restriction fragment length polymorphisms (RFLPs).

Each of the sequences described herein can, to some degree, be used as a standard against which DNA from an individual can be compared for identification purposes. Because greater numbers of polymorphisms occur in the noncoding regions, fewer sequences are necessary to differentiate individuals. The noncoding sequences can comfortably provide positive individual identification with a panel of perhaps 10 to 1,000 primers that each yield a noncoding amplified sequence of 100 bases. If predicted coding sequences, such as those in SEQ ID NOS:1, 3, 5, 7, 9, 11, 13, 15, 17, 19, 21, 23, 25, 27, 29, 31, 33, 35, 37, 39 and 319 are used, a more appropriate number of primers for positive individual identification would be 500–2,000.

Predictive Medicine

The invention also pertains to the field of predictive medicine in which diagnostic assays, prognostic assays, pharmacogenomics, and monitoring clinical trials are used for prognostic (predictive) purposes to thereby treat an individual prophylactically. Accordingly, one aspect of the invention relates to diagnostic assays for determining SECX and/or NOVX protein and/or nucleic acid expression as well as SECX and/or NOVX activity, in the context of a biological sample (e.g., blood, serum, cells, tissue) to thereby determine whether an individual is afflicted with a disease or disorder, or is at risk of developing a disorder, associated with aberrant SECX and/or NOVX expression or activity. The disorders include metabolic disorders, diabetes, obesity, infectious disease, anorexia, cancer-associated cachexia, cancer, neurodegenerative disorders, Alzheimer's Disease, Parkinson's Disorder, immune disorders, and hematopoietic disorders, and the various dyslipidemias, metabolic disturbances associated with obesity, the metabolic syndrome X and wasting disorders associated with chronic diseases and various cancers. The invention also provides for prognostic (or predictive) assays for determining whether an individual is at risk of developing a disorder associated with SECX and/or NOVX protein, nucleic acid expression or activity. For example, mutations in an SECX and/or NOVX gene can be assayed in a biological sample. Such assays can be used for prognostic or predictive purpose to thereby prophylactically treat an individual prior to the onset of a disorder characterized by or associated with SECX and/or NOVX protein, nucleic acid expression, or biological activity.

Another aspect of the invention provides methods for determining SECX and/or NOVX protein, nucleic acid expression or activity in an individual to thereby select appropriate therapeutic or prophylactic agents for that individual (referred to herein as "pharmacogenomics"). Pharmacogenomics allows for the selection of agents (e.g., drugs) for therapeutic or prophylactic treatment of an individual based on the genotype of the individual (e.g., the genotype of the individual examined to determine the ability of the individual to respond to a particular agent.) Yet another aspect of the invention pertains to monitoring the influence of agents (e.g., drugs, compounds) on the expression or activity of SECX and/or NOVX in clinical trials.

These and other agents are described in further detail in the following sections.

Diagnostic Assays

An exemplary method for detecting the presence or absence of SECX and/or NOVX in a biological sample involves obtaining a biological sample from a test subject and contacting the biological sample with a compound or an agent capable of detecting SECX and/or NOVX protein or nucleic acid (e.g., mRNA, genomic DNA) that encodes SECX and/or NOVX protein such that the presence of SECX and/or NOVX is detected in the biological sample. An agent for detecting SECX and/or NOVX mRNA or genomic DNA is a labeled nucleic acid probe capable of hybridizing to SECX and/or NOVX mRNA or genomic DNA. The nucleic acid probe can be, for example, a full-length SECX and/or NOVX nucleic acid, such as the nucleic acid of SEQ ID NOS:1, 3, 5, 7, 9, 11, 13, 15, 17, 19, 21, 23, 25, 27, 29, 31, 33, 35, 37, 39 and 319, or a portion thereof, such as an oligonucleotide of at least 15, 30, 50, 100, 250 or 500 nucleotides in length and sufficient to specifically hybridize under stringent conditions to SECX and/or NOVX mRNA or genomic DNA. Other suitable probes for use in the diagnostic assays of the invention are described herein.

An agent for detecting SECX and/or NOVX protein is an antibody capable of binding to SECX and/or NOVX protein, preferably an antibody with a detectable label. Antibodies can be polyclonal, or more preferably, monoclonal. An intact antibody, or a fragment thereof (e.g., Fab or F(ab')$_2$) can be used. The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently-labeled secondary antibody and end-labeling of a DNA probe with biotin such that it can be detected with fluorescently-labeled streptavidin. The term "biological sample" is intended to include tissues, cells and biological fluids isolated from a subject, as well as tissues, cells and fluids present within a subject. That is, the detection method of the invention can be used to detect SECX and/or NOVX mRNA, protein, or genomic DNA in a biological sample in vitro as well as in vivo. For example, in vitro techniques for detection of SECX and/or NOVX mRNA include Northern hybridizations and in situ hybridizations. In vitro techniques for detection of SECX and/or NOVX protein include enzyme linked immunosorbent assays (ELISAs), Western blots, immunoprecipitations, and immunofluorescence. In vitro techniques for detection of SECX and/or NOVX genomic DNA include Southern hybridizations. Furthermore, in vivo techniques for detection of SECX and/or NOVX protein include introducing into a subject a labeled anti-SECX and/or NOVX antibody. For example, the antibody can be labeled with a radioactive marker whose presence and location in a subject can be detected by standard imaging techniques.

In one embodiment, the biological sample contains protein molecules from the test subject. Alternatively, the biological sample can contain mRNA molecules from the test subject or genomic DNA molecules from the test subject. A preferred biological sample is a peripheral blood leukocyte sample isolated by conventional means from a subject.

In another embodiment, the methods further involve obtaining a control biological sample from a control subject, contacting the control sample with a compound or agent capable of detecting SECX and/or NOVX protein, mRNA, or genomic DNA, such that the presence of SECX and/or NOVX protein, mRNA or genomic DNA is detected in the biological sample, and comparing the presence of SECX and/or NOVX protein, mRNA or genomic DNA in the control sample with the presence of SECX and/or NOVX protein, mRNA or genomic DNA in the test sample.

The invention also encompasses kits for detecting the presence of SECX and/or NOVX in a biological sample. For example, the kit can comprise: a labeled compound or agent capable of detecting SECX and/or NOVX protein or mRNA in a biological sample; means for determining the amount of SECX and/or NOVX in the sample; and means for comparing the amount of SECX and/or NOVX in the sample with a standard. The compound or agent can be packaged in a suitable container. The kit can further comprise instructions for using the kit to detect SECX and/or NOVX protein or nucleic acid.

Prognostic Assays

The diagnostic methods described herein can furthermore be utilized to identify subjects having or at risk of developing a disease or disorder associated with aberrant SECX and/or NOVX expression or activity. For example, the assays described herein, such as the preceding diagnostic assays or the following assays, can be utilized to identify a subject having or at risk of developing a disorder associated with SECX and/or NOVX protein, nucleic acid expression or activity. Alternatively, the prognostic assays can be utilized to identify a subject having or at risk for developing a disease or disorder. Thus, the invention provides a method for identifying a disease or disorder associated with aberrant SECX and/or NOVX expression or activity in which a test sample is obtained from a subject and SECX and/or NOVX protein or nucleic acid (e.g., mRNA, genomic DNA) is detected, wherein the presence of SECX and/or NOVX protein or nucleic acid is diagnostic for a subject having or at risk of developing a disease or disorder associated with aberrant SECX and/or NOVX expression or activity. As used herein, a "test sample" refers to a biological sample obtained from a subject of interest. For example, a test sample can be a biological fluid (e.g., serum), cell sample, or tissue.

Furthermore, the prognostic assays described herein can be used to determine whether a subject can be administered an agent (e.g., an agonist, antagonist, peptidomimetic, protein, peptide, nucleic acid, small molecule, or other drug candidate) to treat a disease or disorder associated with aberrant SECX and/or NOVX expression or activity. For example, such methods can be used to determine whether a subject can be effectively treated with an agent for a disorder. Thus, the invention provides methods for determining whether a subject can be effectively treated with an agent for a disorder associated with aberrant SECX and/or NOVX expression or activity in which a test sample is obtained and SECX and/or NOVX protein or nucleic acid is detected (e.g., wherein the presence of SECX and/or NOVX protein or nucleic acid is diagnostic for a subject that can be administered the agent to treat a disorder associated with aberrant SECX and/or NOVX expression or activity).

The methods of the invention can also be used to detect genetic lesions in an SECX and/or NOVX gene, thereby determining if a subject with the lesioned gene is at risk for a disorder characterized by aberrant cell proliferation and/or differentiation. In various embodiments, the methods include detecting, in a sample of cells from the subject, the presence or absence of a genetic lesion characterized by at least one of an alteration affecting the integrity of a gene encoding an SECX and/or NOVX-protein, or the misexpression of the SECX and/or NOVX gene. For example, such genetic lesions can be detected by ascertaining the existence of at least one of: (i) a deletion of one or more nucleotides from an SECX and/or NOVX gene; (ii) an addition of one or more nucleotides to an SECX and/or NOVX gene; (iii) a substitution of one or more nucleotides of an SECX and/or NOVX gene, (iv) a chromosomal rearrangement of an SECX and/or NOVX gene; (v) an alteration in the level of a messenger RNA transcript of an SECX and/or NOVX gene, (vi) aberrant modification of an SECX and/or NOVX gene, such as of the methylation pattern of the genomic DNA, (vii) the presence of a non-wild-type splicing pattern of a messenger RNA transcript of an SECX and/or NOVX gene, (viii) a non-wild-type level of an SECX and/or NOVX protein, (ix) allelic loss of an SECX and/or NOVX gene, and (x) inappropriate post-translational modification of an SECX and/or NOVX protein. As described herein, there are a large number of assay techniques known in the art which can be used for detecting lesions in an SECX and/or NOVX gene. A preferred biological sample is a peripheral blood leukocyte sample isolated by conventional means from a subject. However, any biological sample containing nucleated cells may be used, including, for example, buccal mucosal cells.

In certain embodiments, detection of the lesion involves the use of a probe/primer in a polymerase chain reaction (PCR) (see, e.g., U.S. Pat. Nos. 4,683,195 and 4,683,202), such as anchor PCR or RACE PCR, or, alternatively, in a ligation chain reaction (LCR) (see, e.g., Landegran, et al., 1988. *Science* 241: 1077–1080; and Nakazawa, et al., 1994. *Proc. Natl. Acad. Sci. USA* 91: 360–364), the latter of which can be particularly useful for detecting point mutations in the SECX and/or NOVX-gene (see, Abravaya, et al., 1995. *Nucl. Acids Res.* 23: 675–682). This method can include the steps of collecting a sample of cells from a patient, isolating nucleic acid (e.g., genomic, mRNA or both) from the cells of the sample, contacting the nucleic acid sample with one or more primers that specifically hybridize to an SECX and/or NOVX gene under conditions such that hybridization and amplification of the SECX and/or NOVX gene (if present) occurs, and detecting the presence or absence of an amplification product, or detecting the size of the amplification product and comparing the length to a control sample. It is anticipated that PCR and/or LCR may be desirable to use as a preliminary amplification step in conjunction with any of the techniques used for detecting mutations described herein.

Alternative amplification methods include: self sustained sequence replication (see, Guatelli, et al., 1990. *Proc. Natl. Acad. Sci. USA* 87: 1874–1878), transcriptional amplification system (see, Kwoh, et al., 1989. *Proc. Natl. Acad. Sci. USA* 86: 1173–1177); Qu Replicase (see, Lizardi, et al, 1988. *BioTechnology* 6: 1197), or any other nucleic acid amplification method, followed by the detection of the amplified molecules using techniques well known to those of skill in the art. These detection schemes are especially useful for the detection of nucleic acid molecules if such molecules are present in very low numbers.

In an alternative embodiment, mutations in an SECX and/or NOVX gene from a sample cell can be identified by alterations in restriction enzyme cleavage patterns. For example, sample and control DNA is isolated, amplified (optionally), digested with one or more restriction endonucleases, and fragment length sizes are determined by gel electrophoresis and compared. Differences in fragment length sizes between sample and control DNA indicates mutations in the sample DNA. Moreover, the use of sequence specific ribozymes (see, e.g., U.S. Pat. No. 5,493, 531) can be used to score for the presence of specific mutations by development or loss of a ribozyme cleavage site.

In other embodiments, genetic mutations in SECX and/or NOVX can be identified by hybridizing a sample and control nucleic acids, e.g., DNA or RNA, to high-density arrays containing hundreds or thousands of oligonucleotides probes. See, e.g., Cronin, et al., 1996. *Human Mutation* 7: 244–255; Kozal, et al., 1996. *Nat. Med.* 2: 753–759. For example, genetic mutations in SECX and/or NOVX can be identified in two dimensional arrays containing light-generated DNA probes as described in Cronin, et al., supra. Briefly, a first hybridization array of probes can be used to scan through long stretches of DNA in a sample and control to identify base changes between the sequences by making linear arrays of sequential overlapping probes. This step allows the identification of point mutations. This is followed by a second hybridization array that allows the characterization of specific mutations by using smaller, specialized probe arrays complementary to all variants or mutations detected. Each mutation array is composed of parallel probe sets, one complementary to the wild-type gene and the other complementary to the mutant gene.

In yet another embodiment, any of a variety of sequencing reactions known in the art can be used to directly sequence the SECX and/or NOVX gene and detect mutations by comparing the sequence of the sample SECX and/or NOVX with the corresponding wild-type (control) sequence. Examples of sequencing reactions include those based on techniques developed by Maxim and Gilbert, 1977. *Proc. Natl. Acad. Sci. USA* 74: 560 or Sanger, 1977. *Proc. Natl. Acad. Sci. USA* 74: 5463. It is also contemplated that any of a variety of automated sequencing procedures can be utilized when performing the diagnostic assays (see, e.g., Naeve, et al., 1995. *Biotechniques* 19: 448), including sequencing by mass spectrometry (see, e.g., PCT International Publication No. WO 94/16101; Cohen, et al., 1996. *Adv. Chromatography* 36: 127–162; and Griffin, et al., 1993. *Appl. Biochem. Biotechnol.* 38: 147–159).

Other methods for detecting mutations in the SECX and/or NOVX gene include methods in which protection from cleavage agents is used to detect mismatched bases in RNA/RNA or RNA/DNA heteroduplexes. See, e.g., Myers, et al., 1985. *Science* 230: 1242. In general, the art technique of "mismatch cleavage" starts by providing heteroduplexes of formed by hybridizing (labeled) RNA or DNA containing the wild-type SECX and/or NOVX sequence with potentially mutant RNA or DNA obtained from a tissue sample. The double-stranded duplexes are treated with an agent that cleaves single-stranded regions of the duplex such as which will exist due to basepair mismatches between the control and sample strands. For instance, RNA/DNA duplexes can be treated with RNase and DNA/DNA hybrids treated with SI nuclease to enzymatically digesting the mismatched regions. In other embodiments, either DNA/DNA or RNA/DNA duplexes can be treated with hydroxylamine or osmium tetroxide and with piperidine in order to digest mismatched regions. After digestion of the mismatched regions, the resulting material is then separated by size on denaturing polyacrylamide gels to determine the site of mutation. See, e.g., Cotton, et al., 1988. *Proc. Natl. Acad. Sci. USA* 85: 4397; Saleeba, et al., 1992. *Methods Enzymol.* 217: 286–295. In an embodiment, the control DNA or RNA can be labeled for detection.

In still another embodiment, the mismatch cleavage reaction employs one or more proteins that recognize mismatched base pairs in double-stranded DNA (so called "DNA mismatch repair" enzymes) in defined systems for detecting and mapping point mutations in SECX and/or NOVX cDNAs obtained from samples of cells. For example, the mutY enzyme of *E. coli* cleaves A at G/A mismatches and the thymidine DNA glycosylase from HeLa cells cleaves T at G/T mismatches. See, e.g., Hsu, et al., 1994. *Carcinogenesis* 15: 1657–1662. According to an exemplary embodiment, a probe based on an SECX and/or NOVX sequence, e.g., a wild-type SECX and/or NOVX sequence, is hybridized to a cDNA or other DNA product from a test cell(s). The duplex is treated with a DNA mismatch repair enzyme, and the cleavage products, if any, can be detected from electrophoresis protocols or the like. See, e.g., U.S. Pat. No. 5,459,039.

In other embodiments, alterations in electrophoretic mobility will be used to identify mutations in SECX and/or NOVX genes. For example, single strand conformation polymorphism (SSCP) may be used to detect differences in electrophoretic mobility between mutant and wild type nucleic acids. See, e.g., Orita, et al., 1989. *Proc. Natl. Acad. Sci. USA:* 86: 2766; Cotton, 1993. *Mutat. Res.* 285: 125–144; Hayashi, 1992. *Genet. Anal. Tech. Appl.* 9: 73–79. Single-stranded DNA fragments of sample and control SECX and/or NOVX nucleic acids will be denatured and allowed to renature. The secondary structure of single-stranded nucleic acids varies according to sequence, the resulting alteration in electrophoretic mobility enables the detection of even a single base change. The DNA fragments may be labeled or detected with labeled probes. The sensitivity of the assay may be enhanced by using RNA (rather than DNA), in which the secondary structure is more sensitive to a change in sequence. In one embodiment, the subject method utilizes heteroduplex analysis to separate double stranded heteroduplex molecules on the basis of changes in electrophoretic mobility. See, e.g., Keen, et al., 1991. *Trends Genet.* 7: 5.

In yet another embodiment, the movement of mutant or wild-type fragments in polyacrylamide gels containing a gradient of denaturant is assayed using denaturing gradient gel electrophoresis (DGGE). See, e.g., Myers, et al., 1985. *Nature* 313: 495. When DGGE is used as the method of analysis, DNA will be modified to insure that it does not completely denature, for example by adding a GC clamp of approximately 40 bp of high-melting GC-rich DNA by PCR. In a further embodiment, a temperature gradient is used in place of a denaturing gradient to identify differences in the mobility of control and sample DNA. See, e.g., Rosenbaum and Reissner, 1987. *Biophys. Chem.* 265: 12753.

Examples of other techniques for detecting point mutations include, but are not limited to, selective oligonucleotide hybridization, selective amplification, or selective primer extension. For example, oligonucleotide primers may be prepared in which the known mutation is placed centrally and then hybridized to target DNA under conditions that permit hybridization only if a perfect match is found. See, e.g., Saiki, et al., 1986. *Nature* 324: 163; Saiki, et al., 1989. *Proc. Natl. Acad. Sci. USA* 86: 6230. Such allele specific oligonucleotides are hybridized to PCR amplified target DNA or a number of different mutations when the oligonucleotides are attached to the hybridizing membrane and hybridized with labeled target DNA.

Alternatively, allele specific amplification technology that depends on selective PCR amplification may be used in conjunction with the instant invention. Oligonucleotides used as primers for specific amplification may carry the mutation of interest in the center of the molecule (so that amplification depends on differential hybridization; see, e.g., Gibbs, et al., 1989. *Nucl. Acids Res.* 17: 2437–2448) or at the extreme 3'-terminus of one primer where, under appropriate conditions, mismatch can prevent, or reduce polymerase extension (see, e.g., Prossner, 1993. *Tibtech.* 11: 238). In addition it may be desirable to introduce a novel restriction site in the region of the mutation to create cleavage-based detection. See, e.g., Gasparini, et al., 1992. *Mol. Cell Probes* 6: 1. It is anticipated that in certain embodiments amplification may also be performed using Taq ligase for amplification. See, e.g., Barany, 1991. *Proc. Natl. Acad. Sci. USA* 88: 189. In such cases, ligation will occur only if there is a perfect match at the 3'-terminus of the 5' sequence, making it possible to detect the presence of a known mutation at a specific site by looking for the presence or absence of amplification.

The methods described herein may be performed, for example, by utilizing pre-packaged diagnostic kits comprising at least one probe nucleic acid or antibody reagent described herein, which may be conveniently used, e.g., in clinical settings to diagnose patients exhibiting symptoms or family history of a disease or illness involving an SECX and/or NOVX gene.

Furthermore, any cell type or tissue, preferably peripheral blood leukocytes, in which SECX and/or NOVX is expressed may be utilized in the prognostic assays described herein. However, any biological sample containing nucleated cells may be used, including, for example, buccal mucosal cells.

Pharmacogenomics

Agents, or modulators that have a stimulatory or inhibitory effect on SECX and/or NOVX activity (e.g., SECX and/or NOVX gene expression), as identified by a screening assay described herein can be administered to individuals to treat (prophylactically or therapeutically) disorders (The disorders include metabolic disorders, diabetes, obesity, infectious disease, anorexia, cancer-associated cachexia, cancer, neurodegenerative disorders, Alzheimer's Disease, Parkinson's Disorder, immune disorders, and hematopoictic disorders, and the various dyslipidemias, metabolic disturbances associated with obesity, the metabolic syndrome X and wasting disorders associated with chronic diseases and various cancers.) In conjunction with such treatment, the pharmacogenomics (i.e., the study of the relationship between an individual's genotype and that individual's response to a foreign compound or drug) of the individual may be considered. Differences in metabolism of therapeutics can lead to severe toxicity or therapeutic failure by altering the relation between dose and blood concentration of the pharmacologically active drug. Thus, the pharmacogenomics of the individual permits the selection of effective agents (e.g., drugs) for prophylactic or therapeutic treatments based on a consideration of the individual's genotype. Such pharmacogenomics can further be used to determine appropriate dosages and therapeutic regimens. Accordingly, the activity of SECX and/or NOVX protein, expression of SECX and/or NOVX nucleic acid, or mutation content of SECX and/or NOVX genes in an individual can be determined to thereby select appropriate agent(s) for therapeutic or prophylactic treatment of the individual.

Pharmacogenomics deals with clinically significant hereditary variations in the response to drugs due to altered drug disposition and abnormal action in affected persons. See e.g., Eichelbaum, 1996. *Clin. Exp. Pharmacol. Plhysiol.*, 23: 983–985; Linder, 1997. *Clin. Chem.*, 43: 254–266. In general, two types of pharmacogenetic conditions can be differentiated. Genetic conditions transmitted as a single factor altering the way drugs act on the body (altered drug action) or genetic conditions transmitted as single factors altering the way the body acts on drugs (altered drug metabolism). These pharmacogenetic conditions can occur either as rare defects or as polymorphisms. For example, glucose-6-phosphate dehydrogenase (G6PD) deficiency is a common inherited enzymopathy in which the main clinical complication is hemolysis after ingestion of oxidant drugs (anti-malarials, sulfonamides, analgesics, nitrofurans) and consumption of fava beans.

As an illustrative embodiment, the activity of drug metabolizing enzymes is a major determinant of both the intensity and duration of drug action. The discovery of genetic polymorphisms of drug metabolizing enzymes (e.g., N-acetyltransferase 2 (NAT 2) and cytochrome PREGNANCY ZONE PROTEIN PRECURSOR enzymes CYP2D6 and CYP2C19) has provided an explanation as to why some patients do not obtain the expected drug effects or show exaggerated drug response and serious toxicity after taking the standard and safe dose of a drug. These polymorphisms are expressed in two phenotypes in the population, the extensive metabolizer (EM) and poor metabolizer (PM). The prevalence of PM is different among different populations. For example, the gene coding for CYP2D6 is highly polymorphic and several mutations have been identified in PM, which all lead to the absence of functional CYP2D6. Poor metabolizers of CYP2D6 and CYP2C19 quite frequently experience exaggerated drug response and side effects when they receive standard doses. If a metabolite is the active therapeutic moiety, PM show no therapeutic response, as demonstrated for the analgesic effect of codeine mediated by its CYP2D6-formed metabolite morphine. At the other extreme are the so called ultra-rapid metabolizers who do not respond to standard doses. Recently, the molecular basis of ultra-rapid metabolism has been identified to be due to CYP2D6 gene amplification.

Thus, the activity of SECX and/or NOVX protein, expression of SECX and/or NOVX nucleic acid, or mutation content of SECX and/or NOVX genes in an individual can be determined to thereby select appropriate agent(s) for therapeutic or prophylactic treatment of the individual. In addition, pharmacogenetic studies can be used to apply genotyping of polymorphic alleles encoding drug-metabolizing enzymes to the identification of an individual's drug responsiveness phenotype. This knowledge, when applied to dosing or drug selection, can avoid adverse reactions or therapeutic failure and thus enhance therapeutic or prophylactic efficiency when treating a subject with an SECX and/or NOVX modulator, such as a modulator identified by one of the exemplary screening assays described herein.

Monitoring of Effects During Clinical Trials

Monitoring the influence of agents (e.g., drugs, compounds) on the expression or activity of SECX and/or NOVX (e.g., the ability to modulate aberrant cell proliferation and/or differentiation) can be applied not only in basic drug screening, but also in clinical trials. For example, the effectiveness of an agent determined by a screening assay as described herein to increase SECX and/or NOVX gene expression, protein levels, or upregulate SECX and/or NOVX activity, can be monitored in clinical trails of subjects exhibiting decreased SECX and/or NOVX gene expression, protein levels, or downregulated SECX and/or NOVX activity. Alternatively, the effectiveness of an agent determined by a screening assay to decrease SECX and/or NOVX gene expression, protein levels, or downregulate SECX and/or NOVX activity, can be monitored in clinical trails of subjects exhibiting increased SECX and/or NOVX gene expression, protein levels, or upregulated SECX and/or NOVX activity. In such clinical trials, the expression or activity of SECX and/or NOVX and, preferably, other genes that have been implicated in, for example, a cellular proliferation or immune disorder can be used as a "read out" or markers of the immune responsiveness of a particular cell.

By way of example, and not of limitation, genes, including SECX and/or NOVX, that are modulated in cells by treatment with an agent (e.g., compound, drug or small molecule) that modulates SECX and/or NOVX activity (e.g., identified in a screening assay as described herein) can be identified. Thus, to study the effect of agents on cellular proliferation disorders, for example, in a clinical trial, cells can be isolated and RNA prepared and analyzed for the levels of expression of SECX and/or NOVX and other genes implicated in the disorder. The levels of gene expression (i.e., a gene expression pattern) can be quantified by Northern blot analysis or RT-PCR, as described herein, or alternatively by measuring the amount of protein produced, by one of the methods as described herein, or by measuring the levels of activity of SECX and/or NOVX or other genes. In this manner, the gene expression pattern can serve as a marker, indicative of the physiological response of the cells to the agent. Accordingly, this response state may be determined before, and at various points during, treatment of the individual with the agent.

In one embodiment, the invention provides a method for monitoring the effectiveness of treatment of a subject with an agent (e.g., an agonist, antagonist, protein, peptide, peptidomimetic, nucleic acid, small molecule, or other drug candidate identified by the screening assays described herein) comprising the steps of (i) obtaining a pre-administration sample from a subject prior to administration of the agent; (ii) detecting the level of expression of an SECX and/or NOVX protein, mRNA, or genomic DNA in the preadministration sample; (iii) obtaining one or more post-administration samples from the subject; (iv) detecting the level of expression or activity of the SECX and/or NOVX protein, mRNA, or genomic DNA in the post-administration samples; (v) comparing the level of expression or activity of the SECX and/or NOVX protein, mRNA, or genomic DNA in the pre-administration sample with the SECX and/or NOVX protein, mRNA, or genomic DNA in the post administration sample or samples; and (vi) altering the administration of the agent to the subject accordingly. For example, increased administration of the agent may be desirable to increase the expression or activity of SECX and/or NOVX to higher levels than detected, i.e., to increase the effectiveness of the agent. Alternatively, decreased administration of the agent may be desirable to decrease expression or activity of SECX and/or NOVX to lower levels than detected, i.e., to decrease the effectiveness of the agent.

Methods of Treatment

The invention provides for both prophylactic and therapeutic methods of treating a subject at risk of (or susceptible to) a disorder or having a disorder associated with aberrant SECX and/or NOVX expression or activity. The disorders include cardiomyopathy, atherosclerosis, hypertension, congenital heart defects, aortic stenosis, atrial septal defect (ASD), atrioventricular (A-V) canal defect, ductus arteriosus, pulmonary stenosis, subaortic stenosis, ventricular septal defect (VSD), valve diseases, tuberous sclerosis, scleroderma, obesity, transplantation, adrenoleukodystrophy, congenital adrenal hyperplasia, prostate cancer, neoplasm; adenocarcinoma, lymphoma, uterus cancer, fertility, hemophilia, hypercoagulation, idiopathic thrombocytopenic purpura, immunodeficiencies, graft versus host disease, AIDS, bronchial asthma, Crohn's disease; multiple sclerosis, treatment of Albright Hereditary Ostoeodystrophy, and other diseases, disorders and conditions of the like.

These methods of treatment will be discussed more fully, below.

Disease and Disorders

Diseases and disorders that are characterized by increased (relative to a subject not suffering from the disease or disorder) levels or biological activity may be treated with Therapeutics that antagonize (i.e., reduce or inhibit) activity. Therapeutics that antagonize activity may be administered in a therapeutic or prophylactic manner. Therapeutics that may be utilized include, but are not limited to: (i) an aforementioned peptide, or analogs, derivatives, fragments or homologs thereof; (ii) antibodies to an aforementioned peptide; (iii) nucleic acids encoding an aforementioned peptide; (iv) administration of antisense nucleic acid and nucleic acids that are "dysfunctional" (i.e., due to a heterologous insertion within the coding sequences of coding sequences to an aforementioned peptide) that are utilized to "knockout" endogenous function of an aforementioned peptide by homologous recombination (see, erg., Capecchi, 1989. *Science* 244: 1288–1292); or (v) modulators (i.e., inhibitors, agonists and antagonists, including additional peptide mimetic of the invention or antibodies specific to a peptide of the invention) that alter the interaction between an aforementioned peptide and its binding partner.

Diseases and disorders that are characterized by decreased (relative to a subject not suffering from the disease or disorder) levels or biological activity may be treated with Therapeutics that increase (i.e., are agonists to) activity. Therapeutics that upregulate activity may be administered in a therapeutic or prophylactic manner. Therapeutics that may be utilized include, but are not limited to, an aforementioned peptide, or analogs, derivatives, fragments or homologs thereof, or an agonist that increases bioavailability.

Increased or decreased levels can be readily detected by quantifying peptide and/or RNA, by obtaining a patient tissue sample (e.g., from biopsy tissue) and assaying it in vitro for RNA or peptide levels, structure and/or activity of the expressed peptides (or mRNAs of an aforementioned peptide). Methods that are well-known within the art include, but are not limited to, immunoassays (e.g., by Western blot analysis, immunoprecipitation followed by sodium dodecyl sulfate (SDS) polyacrylamide gel electrophoresis, immunocytochemistry, etc.) and/or hybridization assays to detect expression of mRNAs (e.g., Northern assays, dot blots, in situ hybridization, and the like).

Prophylactic Methods

In one aspect, the invention provides a method for preventing, in a subject, a disease or condition associated with an aberrant SECX and/or NOVX expression or activity, by administering to the subject an agent that modulates SECX and/or NOVX expression or at least one SECX and/or NOVX activity. Subjects at risk for a disease that is caused or contributed to by aberrant SECX and/or NOVX expression or activity can be identified by, for example, any or a combination of diagnostic or prognostic assays as described herein. Administration of a prophylactic agent can occur prior to the manifestation of symptoms characteristic of the SECX and/or NOVX aberrancy, such that a disease or disorder is prevented or, alternatively, delayed in its progression. Depending upon the type of SECX and/or NOVX aberrancy, for example, an SECX and/or NOVX agonist or SECX and/or NOVX antagonist agent can be used for treating the subject. The appropriate agent can be determined based on screening assays described herein. The prophylactic methods of the invention are further discussed in the following subsections.

Therapeutic Methods

Another aspect of the invention pertains to methods of modulating SECX and/or NOVX expression or activity for therapeutic purposes. The modulatory method of the invention involves contacting a cell with an agent that modulates one or more of the activities of SECX and/or NOVX protein activity associated with the cell. An agent that modulates SECX and/or NOVX protein activity can be an agent as described herein, such as a nucleic acid or a protein, a naturally-occurring cognate ligand of an SECX and/or NOVX protein, a peptide, an SECX and/or NOVX peptidomimetic, or other small molecule. In one embodiment, the agent stimulates one or more SECX and/or NOVX protein activity. Examples of such stimulatory agents include active SECX and/or NOVX protein and a nucleic acid molecule encoding SECX and/or NOVX that has been introduced into the cell. In another embodiment, the agent inhibits one or more SECX and/or NOVX protein activity. Examples of such inhibitory agents include antisense SECX and/or NOVX nucleic acid molecules and anti-SECX and/or NOVX antibodies. These modulatory methods can be performed in vitro (e.g., by culturing the cell with the agent) or, alternatively, in vivo (e.g., by administering the agent to a subject). As such, the invention provides methods of treating an individual afflicted with a disease or disorder characterized by aberrant expression or activity of an SECX and/or NOVX protein or nucleic acid molecule. In one embodiment, the method involves administering an agent (e.g., an agent identified by a screening assay described herein), or combination of agents that modulates (e.g., up-regulates or down-regulates) SECX and/or NOVX expression or activity. In another embodiment, the method involves administering an SECX and/or NOVX protein or nucleic acid molecule as therapy to compensate for reduced or aberrant SECX and/or NOVX expression or activity.

Stimulation of SECX and/or NOVX activity is desirable in situations in which SECX and/or NOVX is abnormally downregulated and/or in which increased SECX and/or NOVX activity is likely to have a beneficial effect. One example of such a situation is where a subject has a disorder characterized by aberrant cell proliferation and/or differentiation (e.g., cancer or immune associated disorders). Another example of such a situation is where the subject has a gestational disease (e.g., preclampsia).

Determination of the Biological Effect of the Therapeutic

In various embodiments of the invention, suitable in vitro or in vivo assays are performed to determine the effect of a specific Therapeutic and whether its administration is indicated for treatment of the affected tissue.

In various specific embodiments, in vitro assays may be performed with representative cells of the type(s) involved in the patient's disorder, to determine if a given Therapeutic exerts the desired effect upon the cell type(s). Compounds for use in therapy may be tested in suitable animal model systems including, but not limited to rats, mice, chicken, cows, monkeys, rabbits, and the like, prior to testing in human subjects. Similarly, for in vivo testing, any of the animal model system known in the art may be used prior to administration to human subjects.

Prophylactic and Therapeutic Uses of the Compositions of the Invention

The SECX and/or NOVX nucleic acids and proteins of the invention are useful in potential prophylactic and therapeutic applications implicated in a variety of disorders including, but not limited to: metabolic disorders, diabetes, obesity, infectious disease, anorexia, cancer-associated cancer, neurodegenerative disorders, Alzheimer's Disease, Parkinson's Disorder, immune disorders, hematopoictic disorders, and the various dyslipidemias, metabolic disturbances associated with obesity, the metabolic syndrome X and wasting disorders associated with chronic diseases and various cancers.

As an example, a cDNA encoding the SECX and/or NOVX protein of the invention may be useful in gene therapy, and the protein may be useful when administered to a subject in need thereof. By way of non-limiting example, the compositions of the invention will have efficacy for treatment of patients suffering from: metabolic disorders, diabetes, obesity, infectious disease, anorexia, cancer-associated cachexia, cancer, neurodegenerative disorders, Alzheimer's Disease, Parkinson's Disorder, immune disorders, hematopoietic disorders, and the various dyslipidemias.

Both the novel nucleic acid encoding the SECX and/or NOVX protein, and the SECX and/or NOVX protein of the invention, or fragments thereof, may also be useful in diagnostic applications, wherein the presence or amount of the nucleic acid or the protein are to be assessed. A further use could be as an anti-bacterial molecule (i.e., some peptides have been found to possess anti-bacterial properties). These materials are further useful in the generation of antibodies, which immunospecifically-bind to the novel substances of the invention for use in therapeutic or diagnostic methods.

The invention will be further described in the following examples, which do not limit the scope of the invention described in the claims.

EXAMPLES

Example 1

Identification of SECX and/or NOVX Clones

The novel SECX and/or NOVX target sequences identified in the present invention were subjected to the exon linking process to confirm the sequence. PCR primers were designed by starting at the most upstream sequence available, for the forward primer, and at the most downstream sequence available for the reverse primer. Table 15A shows the sequences of the PCR primers used for obtaining different clones. In each case, the sequence was examined, walking inward from the respective termini toward the coding sequence, until a suitable sequence that is either unique or highly selective was encountered, or, in the case of the reverse primer, until the stop codon was reached. Such primers were designed based on in silico predictions for the full length cDNA, part (one or more exons) of the DNA or protein sequence of the target sequence, or by translated homology of the predicted exons to closely related human sequences from other species. These primers were then employed in PCR amplification based on the following pool of human cDNAs: adrenal gland, bone marrow, brain—amygdala, brain—cerebellum, brain—hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea, uterus. Usually the resulting amplicons were gel purified, cloned and sequenced to high redundancy. The PCR product derived from exon linking was cloned into the pCR2.1 vector from Invitrogen. The resulting bacterial clone has an insert covering the entire open reading frame cloned into the pCR2.1 vector. The resulting sequences from all clones were assembled with themselves, with other fragments in CuraGen Corporation's database and with public ESTs. Fragments and ESTs were included as components for an assembly when the extent of their identity with another component of the assembly was at least 95% over 50 bp. In addition, sequence traces were evaluated manually and edited for corrections if appropriate. These procedures provide the sequence reported herein.

Physical clone: Exons were predicted by homology and the intron/exon boundaries were determined using standard genetic rules. Exons were further selected and refined by means of similarity determination using multiple BLAST (for example, tBlastN, BlastX, and BlastN) searches, and, in some instances, GeneScan and Grail. Expressed sequences from both public and proprietary databases were also added when available to further define and complete the gene sequence. The DNA sequence was then manually corrected for apparent inconsistencies thereby obtaining the sequences encoding the full-length protein.

Example 2

Quantitative Expression Analysis of Clones in Various Cells and Tissues

The quantitative expression of various clones was assessed using microtiter plates containing RNA samples from a variety of normal and pathology-derived cells, cell lines and tissues using real time quantitative PCR (RTQ PCR). RTQ PCR was performed on an Applied Biosystems ABI PRISM® 7700 or an ABI PRISM® 7900 HT Sequence Detection System. Various collections of samples are assembled on the plates, and referred to as Panel 1 (containing normal tissues and cancer cell lines), Panel 2 (containing samples derived from tissues from normal and cancer sources), Panel 3 (containing cancer cell lines), Panel 4 (containing cells and cell lines from normal tissues and cells related to inflammatory conditions), Panel 5D/5I (containing human tissues and cell lines with an emphasis on metabolic diseases), AI_comprehensive_panel (containing normal tissue and samples from autoimmune diseases), Panel CNSD.01 (containing central nervous system samples from normal and diseased brains) and CNS_neurodegeneration_panel (containing samples from normal and Alzheimer's diseased brains).

RNA integrity from all samples is controlled for quality by visual assessment of agarose gel electropherograms using 28S and 18S ribosomal RNA staining intensity ratio as a guide (2:1 to 2.5:1 28 s: 18 s) and the absence of low molecular weight RNAs that would be indicative of degradation products. Samples are controlled against genomic DNA contamination by RTQ PCR reactions run in the absence of reverse transcriptase using probe and primer sets designed to amplify across the span of a single exon.

First, the RNA samples were normalized to reference nucleic acids such as constitutively expressed genes (for example, $\beta$-actin and GAPDH). Normalized RNA (5 ul) was converted to cDNA and analyzed by RTQ-PCR using One Step RT-PCR Master Mix Reagents (Applied Biosystems; Catalog No. 4309169) and gene-specific primers according to the manufacturer's instructions.

In other cases, non-normalized RNA samples were converted to single strand cDNA (sscDNA) using Superscript TI (Invitrogen Corporation; Catalog No. 18064-147) and random hexamers according to the manufacturer's instructions. Reactions containing up to 10 µg of total RNA were performed in a volume of 20 µl and incubated for 60 minutes at 42° C. This reaction can be scaled up to 50 µg of total RNA in a final volume of 100 µl. sscDNA samples are then normalized to reference nucleic acids as described previously, using 1× TaqMan® Universal Master mix (Applied Biosystems; catalog No. 4324020), following the manufacturer's instructions.

Probes and primers were designed for each assay according to Applied Biosystems Primer Express Software package (version I for Apple Computer's Macintosh Power PC) or a similar algorithm using the target sequence as input. Default settings were used for reaction conditions and the following parameters were set before selecting primers: primer concentration=250 nM, primer melting temperature (Tm) range=58°–60° C., primer optimal Tm=59° C., maximum primer difference=2° C., probe does not have 5'G, probe Tm must be 10° C. greater than primer Tm, amplicon size 75 bp to 100 bp. The probes and primers selected (see below) were synthesized by Synthegen (Houston, Tex., USA). Probes were double purified by HPLC to remove uncoupled dye and evaluated by mass spectroscopy to verify coupling of reporter and quencher dyes to the 5' and 3' ends of the probe, respectively. Their final concentrations were: forward and reverse primers, 900 nM each, and probe, 200 nM.

PCR conditions: When working with RNA samples, normalized RNA from each tissue and each cell line was spotted in each well of either a 96 well or a 384-well PCR plate (Applied Biosystems). PCR cocktails included either a single gene specific probe and primers set, or two multiplexed probe and primers sets (a set specific for the target clone and another gene-specific set multiplexed with the target probe). PCR reactions were set up using TaqMan® One-Step RT-PCR Master Mix (Applied Biosystems, Catalog No. 4313803) following manufacturer's instructions. Reverse transcription was performed at 48° C. for 30 minutes followed by amplification/PCR cycles as follows: 95° C. 10 min, then 40 cycles of 95° C. for 15 seconds, 60° C. for 1 minute. Results were recorded as CT values (cycle at which a given sample crosses a threshold level of fluorescence) using a log scale, with the difference in RNA concentration between a given sample and the sample with the lowest CT value being represented as 2 to the power of delta CT. The percent relative expression is then obtained by taking the reciprocal of this RNA difference and multiplying by 100.

When working with sscDNA samples, normalized sscDNA was used as described previously for RNA samples. PCR reactions containing one or two sets of probe and primers were set up as described previously, using 1× TaqMan® Universal Master mix (Applied Biosystems; catalog No. 4324020), following the manufacturer's instructions. PCR amplification was performed as follows: 95° C. 10 min, then 40 cycles of 95° C. for 15 seconds, 60° C. for 1 minute. Results were analyzed and processed as described previously.

Panels 1, 1.1, 1.2, and 1.3D

The plates for Panels 1, 1.1, 1.2 and 1.3D include 2 control wells (genomic DNA control and chemistry control) and 94 wells containing cDNA from various samples. The samples in these panels are broken into 2 classes: samples derived from cultured cell lines and samples derived from primary normal tissues. The cell lines are derived from cancers of the following types: lung cancer, breast cancer, melanoma, colon cancer, prostate cancer, CNS cancer, squamous cell carcinoma, ovarian cancer, liver cancer, renal cancer, gastric cancer and pancreatic cancer. Cell lines used in these panels are widely available through the American Type Culture Collection (ATCC), a repository for cultured cell lines, and were cultured using the conditions recommended by the ATCC. The normal tissues found on these panels are comprised of samples derived from all major organ systems from single adult individuals or fetuses. These samples are derived from the following organs: adult skeletal muscle, fetal skeletal muscle, adult heart, fetal heart, adult kidney, fetal kidney, adult liver, fetal liver, adult lung, fetal lung, various regions of the brain, the spleen, bone marrow, lymph node, pancreas, salivary gland, pituitary gland, adrenal gland, spinal cord, thymus, stomach, small intestine, colon, bladder, trachea, breast, ovary, uterus, placenta, prostate, testis and adipose.

In the results for Panels 1, 1.1, 1.2 and 1.3D, the following abbreviations are used:

ca.=carcinoma,

*=established from metastasis, met=metastasis, s cell var=small cell variant, non-s=non-sm=non-small, squam=squamous, pl. eff=pl effusion=pleural effusion, glio=glioma, astro=astrocytoma, and neuro=neuroblastoma.

General_Screening_Panel_v1.4

The plates for Panel 1.4 include 2 control wells (genomic DNA control and chemistry control) and 94 wells containing cDNA from various samples. The samples in Panel 1.4 are broken into 2 classes: samples derived, from cultured cell lines and samples derived from primary normal tissues. The cell lines are derived from cancers of the following types: lung cancer, breast cancer, melanoma, colon cancer, prostate cancer, CNS cancer, squamous cell carcinoma, ovarian cancer, liver cancer, renal cancer, gastric cancer and pancreatic cancer. Cell lines used in Panel 1.4 are widely available through the American Type Culture Collection (ATCC), a repository for cultured cell lines, and were cultured using the conditions recommended by the ATCC. The normal tissues found on Panel 1.4 are comprised of pools of samples derived from all major organ systems from 2 to 5 different adult individuals or fetuses. These samples are derived from the following organs: adult skeletal muscle, fetal skeletal muscle, adult heart, fetal heart, adult kidney, fetal kidney, adult liver, fetal liver, adult lung, fetal lung, various regions of the brain, the spleen, bone marrow, lymph node, pancreas, salivary gland, pituitary gland, adrenal gland, spinal cord, thymus, stomach, small intestine, colon, bladder, trachea, breast, ovary, uterus, placenta, prostate, testis and adipose. Abbreviations are as described for Panels 1, 1.1, 1.2, and 1.3D.

Panels 2D and 2.2

The plates for Panels 2D and 2.2 generally include 2 control wells and 94 test samples composed of RNA or cDNA isolated from human tissue procured by surgeons working in close cooperation with the National Cancer Institute's Cooperative Human Tissue Network (CHTN) or the National Disease Research Initiative (NDRI). The tissues are derived from human malignancies and in cases where indicated many malignant tissues have "matched margins" obtained from noncancerous tissue just adjacent to the tumor. These are termed normal adjacent tissues and are denoted "NAT" in the results below. The tumor tissue and the "matched margins" are evaluated by two independent pathologists (the surgical pathologists and again by a pathologist at NDRI or CHTN). This analysis provides a gross histopathological assessment of tumor differentiation grade. Moreover, most samples include the original surgical pathology report that provides information regarding the clinical stage of the patient. These matched margins are taken from the tissue surrounding (i.e. immediately proximal) to the zone of surgery (designated "NAT", for normal adjacent tissue, in Table RR). In addition, RNA and cDNA samples were obtained from various human tissues derived from autopsies performed on elderly people or sudden death victims (accidents, etc.). These tissues were ascertained to be free of disease and were purchased from various commercial sources such as Clontech (Palo Alto, Calif.), Research Genetics, and Invitrogen.

Panel 3D

The plates of Panel 3D are comprised of 94 cDNA samples and two control samples. Specifically, 92 of these samples are derived from cultured human cancer cell lines, 2 samples of human primary cerebellar tissue and 2 controls. The human cell lines are generally obtained from ATCC (American Type Culture Collection), NCI or the German tumor cell bank and fall into the following tissue groups: Squamous cell carcinoma of the tongue, breast cancer, prostate cancer, melanoma, epidermoid carcinoma, sarcomas, bladder carcinomas, pancreatic cancers, kidney cancers, leukemias/lymphomas, ovarian/uterine/cervical, gastric, colon, lung and CNS cancer cell lines. In addition, there are two independent samples of cerebellum. These cells are all cultured under standard recommended conditions and RNA extracted using the standard procedures. The cell lines in panel 3D and 1.3D are of the most common cell lines used in the scientific literature.

Panels 4D, 4R, and 4.1D

Panel 4 includes samples on a 96 well plate (2 control wells, 94 test samples) composed of RNA (Panel 4R) or cDNA (Panels 4D/4.1D) isolated from various human cell lines or tissues related to inflammatory conditions. Total RNA from control normal tissues such as colon and lung (Stratagene, La Jolla, Calif.) and thymus and kidney (Clontech) was employed. Total RNA from liver tissue from cirrhosis patients and kidney from lupus patients was obtained from BioChain (Biochain Institute, Inc., Hayward, Calif.). Intestinal tissue for RNA preparation from patients diagnosed as having Crohn's disease and ulcerative colitis was obtained from the National Disease Research Interchange (NDRI) (Philadelphia, Pa.).

Astrocytes, lung fibroblasts, dermal fibroblasts, coronary artery smooth muscle cells, small airway epithelium, bronchial epithelium, microvascular dermal endothelial cells, microvascular lung endothelial cells, human pulmonary aortic endothelial cells, human umbilical vein endothelial cells were all purchased from Clonetics (Walkersville, Md.) and grown in the media supplied for these cell types by Clonetics. These primary cell types were activated with various cytokines or combinations of cytokines for 6 and/or 12–14 hours, as indicated. The following cytokines were used; IL-1 beta at approximately 1–5 ng/ml, TNF alpha at approximately 5–10 ng/ml, IFN gamma at approximately 20–50 ng/ml, IL-4 at approximately 5–10 ng/ml, IL-9 at approximately 5–10 ng/ml, IL-13 at approximately 5–10 ng/ml. Endothelial cells were sometimes starved for various times by culture in the basal media from Clonetics with 0.1% serum.

Mononuclear cells were prepared from blood of employees at CuraGen Corporation, using Ficoll. LAK cells were prepared from these cells by culture in DMEM 5% FCS (Hyclone), 100 $\mu$M non essential amino acids (Gibco/Life Technologies, Rockville, Md.), 1 mM sodium pyruvate (Gibco), mercaptoethanol $5.5 \times 10^{-5}$M (Gibco), and 10 mM Hepes (Gibco) and Interleukin 2 for 4–6 days. Cells were then either activated with 10–20 ng/ml PMA and 1–2 $\mu$g/ml ionomycin, IL-12 at 5–10 ng/ml, IFN gamma at 20–50 ng/ml and IL-18 at 5–10 ng/ml for 6 hours. In some cases, mononuclear cells were cultured for 4–5 days in DMEM 5% FCS (Hyclone), 100 $\mu$M non essential amino acids (Gibco), 1 mM sodium pyruvate (Gibco), mercaptoethanol $5.5 \times 10^{-5}$M (Gibco), and 10 mM Hepes (Gibco) with PHA (phytohemagglutinin) or PWM (pokeweed mitogen) at approximately 5 $\mu$g/ml. Samples were taken at 24, 48 and 72 hours for RNA preparation. MLR (mixed lymphocyte reaction) samples were obtained by taking blood from two donors, isolating the mononuclear cells using Ficoll and mixing the isolated mononuclear cells 1:1 at a final concentration of approximately $2 \times 10^6$ cells/ml in DMEM 5% FCS (Hyclone), 100 $\mu$M non essential amino acids (Gibco), 1 mM sodium pyruvate (Gibco), mercaptoethanol ($5.5 \times 10^{-5}$M) (Gibco), and 10 mM Hepes (Gibco). The MLR was cultured and samples taken at various time points ranging from 1–7 days for RNA preparation.

Monocytes were isolated from mononuclear cells using CD14 Miltenyi Beads, +ve VS selection columns and a Vario Magnet according to the manufacturer's instructions. Monocytes were differentiated into dendritic cells by culture in DMEM 5% fetal calf serum (FCS) (Hyclone, Logan, Utah), 100 $\mu$M non essential amino acids (Gibco), 1 mM sodium pyruvate (Gibco), mercaptoethanol $5.5 \times 10^{-5}$M (Gibco), and 10 mM Hepes (Gibco), 50 ng/ml GMCSF and 5 ng/ml IL-4 for 5–7 days. Macrophages were prepared by culture of monocytes for 5–7 days in DMEM 5% FCS (Hyclone), 100 μM non essential amino acids (Gibco), 1 mM sodium pyruvate (Gibco), mercaptoethanol $5.5 \times 10^{-5}$M (Gibco), 10 mM Hepes (Gibco) and 10% AB Human Serum or MCSF at approximately 50 ng/ml. Monocytes, macrophages and dendritic cells were stimulated for 6 and 12–14 hours with lipopolysaccharide (LPS) at 100 ng/ml. Dendritic cells were also stimulated with anti-CD40 monoclonal antibody (Pharmingen) at 10 μg/ml for 6 and 12–14 hours.

CD4 lymphocytes, CD8 lymphocytes and NK cells were also isolated from mononuclear cells using CD4, CD8 and CD56 Miltenyi beads, positive VS selection columns and a Vario Magnet according to the manufacturer's instructions. CD45RA and CD45RO CD4 lymphocytes were isolated by depleting mononuclear cells of CD8, CD56, CD14 and CD19 cells using CD8, CD56, CD14 and CD19 Miltenyi beads and positive selection. CD45RO beads were then used to isolate the CD45RO CD4 lymphocytes with the remaining cells being CD45RA CD4 lymphocytes. CD45RA CD4, CD45RO CD4 and CD8 lymphocytes were placed in DMEM 5% FCS (Hyclone), 100 μM non essential amino acids (Gibco), 1 mM sodium pyruvate (Gibco), mercaptoethanol $5.5 \times 10^{-5}$M (Gibco), and 10 mM Hepes (Gibco) and plated at $10^6$ cells/ml onto Falcon 6 well tissue culture plates that had been coated overnight with 0.5 μg/ml anti-CD28 (Pharmingen) and 3 μg/ml anti-CD3 (OKT3, ATCC) in PBS. After 6 and 24 hours, the cells were harvested for RNA preparation. To prepare chronically activated CD8 lymphocytes, we activated the isolated CD8 lymphocytes for 4 days on anti-CD28 and anti-CD3 coated plates and then harvested the cells and expanded them in DMEM 5% FCS (Hyclone), 100 μM non essential amino acids (Gibco), 1 mM sodium pyruvate (Gibco), mercaptoethanol $5.5 \times 10^{-5}$M (Gibco), and 10 mM Hepes (Gibco) and IL-2. The expanded CD8 cells were then activated again with plate bound anti-CD3 and anti-CD28 for 4 days and expanded as before. RNA was isolated 6 and 24 hours after the second activation and after 4 days of the second expansion culture. The isolated NK cells were cultured in DMEM 5% FCS (Hyclone), 100 μM non essential amino acids (Gibco), 1 mM sodium pyruvate (Gibco), mercaptoethanol $5.5 \times 10^{-5}$M (Gibco), and 10 mM Hepes (Gibco) and IL-2 for 4–6 days before RNA was prepared.

To obtain B cells, tonsils were procured from NDRI. The tonsil was cut up with sterile dissecting scissors and then passed through a sieve. Tonsil cells were then spun down and resupended at $10^6$ cells/ml in DMEM 5% FCS (Hyclone), 100μM non essential amino acids (Gibco), 1 mM sodium pyruvate (Gibco), mercaptoethanol $5.5 \times 10^{-5}$M (Gibco), and 10 mM Hepes (Gibco). To activate the cells, we used PWM at 5 μg/ml or anti-CD40 (Pharmingen) at approximately 10 μg/ml and IL-4 at 5–10 ng/ml. Cells were harvested for RNA preparation at 24, 48 and 72 hours.

To prepare the primary and secondary Th1/Th2 and Tr1 cells, six-well Falcon plates were coated overnight with 10 μg/ml anti-CD28 (Pharmingen) and 2μg/ml OKT3 (ATCC), and then washed twice with PBS. Umbilical cord blood CD4 lymphocytes (Poietic Systems, German Town, Md.) were cultured at $10^5$–$10^6$ cells/ml in DMEM 5% FCS (Hyclone), 100 μM non essential amino acids (Gibco), 1 mM sodium pyruvate (Gibco), mercaptoethanol $5.5 \times 10^{-5}$M (Gibco), 10 mM Hepes (Gibco) and IL-2 (4 ng/ml). IL-12 (5 ng/ml) and anti-IL4 (1 μg/ml) were used to direct to Th1, while IL-4 (5 ng/ml) and anti-IFN gamma (1 μg/ml) were used to direct to Th2 and IL-10 at 5 ng/ml was used to direct to Tr1. After 4–5 days, the activated Th1, Th2 and Tr1 lymphocytes were washed once in DMEM and expanded for 4–7 days in DMEM 5% FCS (Hyclone), 100 μM non essential amino acids (Gibco), 1 mM sodium pyruvate (Gibco), mercaptoethanol $5.5 \times 10^{-5}$M (Gibco), 10 mM Hepes (Gibco) and IL-2 (1 ng/ml). Following this, the activated Th1, Th2 and Tr1 lymphocytes were re-stimulated for 5 days with anti-CD28/ OKT3 and cytokines as described above, but with the addition of anti-CD95L (1 μg/ml) to prevent apoptosis. After 4–5 days, the Th1, Th2 and Tr1 lymphocytes were washed and then expanded again with IL-2 for 4–7 days. Activated Th1 and Th2 lymphocytes were maintained in this way for a maximum of three cycles. RNA was prepared from primary and secondary Th1, Th2 and Tr1 after 6 and 24 hours following the second and third activations with plate bound anti-CD3 and anti-CD28 mAbs and 4 days into the second and third expansion cultures in Interleukin 2.

The following leukocyte cells lines were obtained from the ATCC: Ramos, EOL-1, KU-812. EOL cells were further differentiated by culture in 0.1 mM dbcAMP at $5 \times 10^5$ cells/ml for 8 days, changing the media every 3 days and adjusting the cell concentration to $5 \times 10^5$ cells/ml. For the culture of these cells, we used DMEM or RPMI (as recommended by the ATCC), with the addition of 5% FCS (Hyclone), 100 μM non essential amino acids (Gibco), 1 mM sodium pyruvate (Gibco), mercaptoethanol $5.5 \times 10^{-5}$M (Gibco), 10 mM Hepes (Gibco). RNA was either prepared from resting cells or cells activated with PMA at 10 ng/ml and ionomycin at 1 μg/ml for 6 and 14 hours. Keratinocyte line CCD 106 and an airway epithelial tumor line NCI-H292 were also obtained from the ATCC. Both were cultured in DMEM 5% FCS (Hyclone), 100 μM non essential amino acids (Gibco), 1 mM sodium pyruvate (Gibco), mercaptoethanol $5.5 \times 10^{-5}$M (Gibco), and 10 mM Hepes (Gibco). CCD1106 cells were activated for 6 and 14 hours with approximately 5 ng/ml TNF alpha and 1 ng/ml IL-1 beta, while NCI-H292 cells were activated for 6 and 14 hours with the following cytokines: 5 ng/ml IL-4, 5 ng/ml IL-9, 5 ng/ml IL-13 and 25 ng/ml IFN gamma.

For these cell lines and blood cells, RNA was prepared by lysing approximately $10^7$ cells/ml using Trizol (Gibco BRL). Briefly, 1/10 volume of bromochloropropane (Molecular Research Corporation) was added to the RNA sample, vortexed and after 10 minutes at room temperature, the tubes were spun at 14,000 rpm in a Sorvall SS34 rotor. The aqueous phase was removed and placed in a 15 ml Falcon Tube. An equal volume of isopropanol was added and left at −20° C. overnight. The precipitated RNA was spun down at 9,000 rpm for 15 min in a Sorvall SS34 rotor and washed in 70% ethanol. The pellet was redissolved in 300 μl of RNAse-free water and 35 μl buffer (Promega) 5 μl DTT, 7 μl RNAsin and 8 μl DNAse were added. The tube was incubated at 37° C. for 30 minutes to remove contaminating genomic DNA, extracted once with phenol chloroform and re-precipitated with 1/10 volume of 3M sodium acetate and 2 volumes of 100% ethanol. The RNA was spun down and placed in RNAse free water. RNA was stored at −80° C.

AI_Comprehensive Panel_v1.0

The plates for AI_comprehensive panel_v1.0 include two control wells and 89 test samples comprised of cDNA isolated from surgical and postmortem human tissues obtained from the Backus Hospital and Clinomics (Frederick, Md.). Total RNA was extracted from tissue samples from the Backus Hospital in the Facility at CuraGen. Total RNA from other tissues was obtained from Clinomics.

Joint tissues including synovial fluid, synovium, bone and cartilage were obtained from patients undergoing total knee or hip replacement surgery at the Backus Hospital. Tissue samples were immediately snap frozen in liquid nitrogen to ensure that isolated RNA was of optimal quality and not degraded. Additional samples of osteoarthritis and rheumatoid arthritis joint tissues were obtained from Clinomics. Normal control tissues were supplied by Clinomics and were obtained during autopsy of trauma victims.

Surgical specimens of psoriatic tissues and adjacent matched tissues were provided as total RNA by Clinomics. Two male and two female patients were selected between the ages of 25 and 47. None of the patients were taking prescription drugs at the time samples were isolated.

Surgical specimens of diseased colon from patients with ulcerative colitis and Crohns disease and adjacent matched tissues were obtained from Clinomics. Bowel tissue from three female and three male Crohn's patients between the ages of 41–69 were used. Two patients were not on prescription medication while the others were taking dexamethasone, phenobarbital, or tylenol. Ulcerative colitis tissue was from three male and four female patients. Four of the patients were taking lebvid and two were on phenobarbital.

Total RNA from post mortem lung tissue from trauma victims with no disease or with emphysema, asthma or COPD was purchased from Clinomics. Emphysema patients ranged in age from 40–70 and all were smokers, this age range was chosen to focus on patients with cigarette-linked emphysema and to avoid those patients with alpha-1 antitrypsin deficiencies. Asthma patients ranged in age from 36–75, and excluded smokers to prevent those patients that could also have COPD. COPD patients ranged in age from 35–80 and included both smokers and non-smokers. Most patients were taking corticosteroids, and bronchodilators.

In the labels employed to identify tissues in the AI_comprehensive panel_v1.0 panel, the following abbreviations are used:

AI=Autoimmunity
Syn=Synovial
Normal=No apparent disease
Rep22/Rep20=individual patients
RA=Rheumatoid arthritis
Backus=From Backus Hospital
OA=Osteoarthritis
(SS) (BA) (MF)=Individual patients
Adj=Adjacent tissue
Match control=adjacent tissues
-M=Male
-F=Female
COPD=Chronic obstructive pulmonary disease
Panels 5D and 5I The plates for Panel 5D and 5I include two control wells and a variety of cDNAs isolated from human tissues and cell lines with an emphasis on metabolic diseases. Metabolic tissues were obtained from patients enrolled in the Gestational Diabetes study. Cells were obtained during different stages in the differentiation of adipocytes from human mesenchymal stem cells. Human pancreatic islets were also obtained.

In the Gestational Diabetes study subjects are young (18–40 years), otherwise healthy women with and without gestational diabetes undergoing routine (elective) Caesarean section. After delivery of the infant, when the surgical incisions were being repaired/closed, the obstetrician removed a small sample (<1 cc) of the exposed metabolic tissues during the closure of each surgical level. The biopsy material was rinsed in sterile saline, blotted and fast frozen within 5 minutes from the time of removal. The tissue was then flash frozen in liquid nitrogen and stored, individually, in sterile screw-top tubes and kept on dry ice for shipment to or to be picked up by CuraGen. The metabolic tissues of interest include uterine wall (smooth muscle), visceral adipose, skeletal muscle (rectus) and subcutaneous adipose. Patient descriptions are as follows:

| Patient 2 | Diabetic Hispanic, overweight, not on insulin |
| Patient 7–9 | Nondiabetic Caucasian and obese (BMI > 30) |
| Patient 10 | Diabetic Hispanic, overweight, on insulin |
| Patient 11 | Nondiabetic African American and overweight |
| Patient 12 | Diabetic Hispanic on insulin |

Adipocyte differentiation was induced in donor progenitor cells obtained from Osirus (a division of Clonetics/BioWhittaker) in triplicate, except for Donor 3U which had only two replicates. Scientists at Clonetics isolated, grew and differentiated human mesenchymal stem cells (HuMSCs) for CuraGen based on the published protocol found in Mark F. Pittenger, et al., Multilineage Potential of Adult Human Mesenchymal Stem Cells Science Apr. 2, 1999: 143–147. Clonetics provided Trizol lysates or frozen pellets suitable for mRNA isolation and ds cDNA production. A general description of each donor is as follows:

Donor 2 and 3 U: Mesenchymal Stem cells, Undifferentiated Adipose

Donor 2 and 3 AM: Adipose, AdiposeMidway Differentiated

Donor 2 and 3 AD: Adipose, Adipose Differentiated

Human cell lines were generally obtained from ATCC (American Type Culture Collection), NCI or the German tumor cell bank and fall into the following tissue groups: kidney proximal convoluted tubule, uterine smooth muscle cells, small intestine, liver HepG2 cancer cells, heart primary stromal cells, and adrenal cortical adenoma cells. These cells are all cultured under standard recommended conditions and RNA extracted using the standard procedures. All samples were processed at CuraGen to produce single stranded cDNA.

Panel 5I contains all samples previously described with the addition of pancreatic islets from a 58 year old female patient obtained from the Diabetes Research Institute at the University of Miami School of Medicine. Islet tissue was processed to total RNA at an outside source and delivered to CuraGen for addition to panel 5I.

In the labels employed to identify tissues in the 5D and 5I panels, the following abbreviations are used:

GO Adipose=Greater Omentum Adipose
SK=Skeletal Muscle
UT=Uterus
PL=Placenta
AD=Adipose Differentiated
AM=Adipose Midway Differentiated
U=Undifferentiated Stem Cells
Panel CNSD.01

The plates for Panel CNSD.01 include two control wells and 94 test samples comprised of cDNA isolated from postmortem human brain tissue obtained from the Harvard Brain Tissue Resource Center. Brains are removed from calvaria of donors between 4 and 24 hours after death, sectioned by neuroanatomists, and frozen at −80° C. in liquid nitrogen vapor. All brains are sectioned and examined by neuropathologists to confirm diagnoses with clear associated neuropathology.

Disease diagnoses are taken from patient records. The panel contains two brains from each of the following diagnoses: Alzheimer's disease, Parkinson's disease, Huntington's disease, Progressive Supernuclear Palsy, Depression, and "Normal controls". Within each of these brains, the following regions are represented: cingulate gyrus, temporal pole, globus palladus, substantia nigra, Brodman Area 4 (primary motor strip), Brodman Area 7 (parietal cortex), Brodman Area 9 (prefrontal cortex), and Brodman area 17 (occipital cortex). Not all brain regions are represented in all cases; e.g., Huntington's disease is characterized in part by neurodegeneration in the globus palladus, thus this region is impossible to obtain from confirmed Huntington's cases. Likewise Parkinson's disease is characterized by degeneration of the substantia nigra making this region more difficult to obtain. Normal control brains were examined for neuropathology and found to be free of any pathology consistent with neurodegeneration.

In the labels employed to identify tissues in the CNS panel, the following abbreviations are used:

PSP=Progressive supranuclear palsy

Sub Nigra=Substantia nigra

Glob Palladus=Globus palladus

Temp Pole=Temporal pole

Cing Gyr=Cingulate gyrus

BA 4=Brodman Area 4

Panel CNS_Neurodegeneration_V1.0

The plates for Panel CNS_Neurodegeneration_V1.0 include two control wells and 47 test samples comprised of cDNA isolated from postmortem human brain tissue obtained from the Harvard Brain Tissue Resource Center (McLean Hospital) and the Human Brain and Spinal Fluid Resource Center (VA Greater Los Angeles Healthcare System). Brains are removed from calvaria of donors between 4 and 24 hours after death, sectioned by neuroanatomists, and frozen at −80° C. in liquid nitrogen vapor. All brains are sectioned and examined by neuropathologists to confirm diagnoses with clear associated neuropathology.

Disease diagnoses are taken from patient records. The panel contains six brains from Alzheimer's disease (AD) patients, and eight brains from "Normal controls" who showed no evidence of dementia prior to death. The eight normal control brains are divided into two categories: Controls with no dementia and no Alzheimer's like pathology (Controls) and controls with no dementia but evidence of severe Alzheimer's like pathology, (specifically senile plaque load rated as level 3 on a scale of 0–3; 0=no evidence of plaques, 3=severe AD senile plaque load). Within each of these brains, the following regions are represented: hippocampus, temporal cortex (Brodman Area 21), parietal cortex (Brodman area 7), and occipital cortex (Brodman area 17). These regions were chosen to encompass all levels of neurodegeneration in AD. The hippocampus is a region of early and severe neuronal loss in AD; the temporal cortex is known to show neurodegeneration in AD after the hippocampus; the panretal cortex shows moderate neuronal death in the late stages of the disease; the occipital cortex is spared in AD and therefore acts as a "control" region within AD patients. Not all brain regions are represented in all cases.

In the labels employed to identify tissues in the CNS_Neurodegeneration_V1.0 panel, the following abbreviations are used:

AD=Alzheimer's disease brain; patient was demented and showed AD-like pathology upon autopsy Control=Control brains; patient not demented, showing no neuropathology Control (Path)=Control brains; pateint not demented but showing sever AD-like pathology SupTemporal Ctx=Superior Temporal Cortex Inf Temporal Ctx=Inferior Temporal Cortex

SEC11 (CG50379-01)

Expression of gene CG50379-01 was assessed using the primer-probe set Ag2255, described in Table 21A. Results of the RTQ-PCR runs are shown in Tables 21B, 21C, 21D, 21E and 21F.

TABLE 21A

Probe Name Ag2255

| Primer | Sequences | | Length | Start Position |
|---|---|---|---|---|
| Forward | 5'-tgcaaaatgaacaaccagacta-3' | (SEQ ID NO:141) | 22 | 1461 |
| Probe | TET-5'-atcccccgccgtggagatcttcat-3'-TAMRA | (SEQ ID NO:142) | 23 | 1512 |
| Reverse | 5'-ccagcagcataaagatcttcac-3' | (SEQ ID NO:143) | 22 | 1536 |

TABLE 21B

AI_comprehensive panel_v1.0

| Tissue Name | Rel. Exp.(%) Ag2255, Run 228157363 | Rel. Exp.(%) Ag2255, Run 228175007 | Tissue Name | Rel. Exp.(%) Ag2255, Run 228157363 | Rel. Exp.(%) Ag2255, Run 228175007 |
|---|---|---|---|---|---|
| 110967 COPD-F | 3.1 | 4.3 | 112427 Match Control Psoriasis-F | 35.8 | 28.7 |
| 110980 COPD-F | 0.0 | 3.0 | 112418 Psoriasis-M | 5.7 | 2.6 |
| 110968 COPD-M | 5.0 | 5.2 | 112723 Match Control Psoriasis-M | 7.6 | 3.4 |
| 110977 COPD-M | 6.0 | 4.5 | 112419 Psoriasis-M | 9.2 | 6.3 |
| 110989 | 58.6 | 69.3 | 112424 Match | 11.7 | 12.1 |

TABLE 21B-continued

AI_comprehensive_panel_v1.0

| Tissue Name | Rel. Exp.(%) Ag2255, Run 228157363 | Rel. Exp.(%) Ag2255, Run 228175007 | Tissue Name | Rel. Exp.(%) Ag2255, Run 228157363 | Rel. Exp.(%) Ag2255, Run 228175007 |
|---|---|---|---|---|---|
| Emphysema-F 110992 | 32.5 | 29.5 | Control Psoriasis-M 112420 Psoriasis-M | 63.3 | 44.4 |
| Emphysema-F 110993 | 4.8 | 4.5 | 112425 Match Control Psoriasis-M | 41.2 | 31.2 |
| Emphysema-F 110994 | 0.9 | 2.1 | 104689 (MF) OA Bone-Backus | 44.1 | 35.6 |
| Emphysema-F 110995 | 100.0 | 100.0 | 104690 (MF) Adj "Normal" Bone-Backus | 9.1 | 13.2 |
| Emphysema-F 110996 | 18.7 | 24.7 | 104691 (MF) OA Synovium-Backus | 88.3 | 80.7 |
| Emphysema-F 110997 Asthma-M | 15.8 | 13.7 | 104692 (BA) OA Cartilage-Backus | 37.4 | 30.1 |
| 111001 Asthma-F | 17.7 | 17.8 | 104694 (BA) OA Bone-Backus | 44.1 | 44.1 |
| 111002 Asthma-F | 36.6 | 0.3 | 104695 (BA) Adj "Normal" Bone-Backus | 9.0 | 9.8 |
| 111003 Atopic Asthma-F | 34.2 | 21.0 | 104696 (BA) OA Synovium-Backus | 88.3 | 98.6 |
| 111004 Atopic Asthma-F | 42.0 | 36.6 | 104700 (SS) OA Bone-Backus | 11.0 | 9.2 |
| 111005 Atopic Asthma-F | 24.1 | 26.4 | 104701 (SS) Adj "Normal" Bone-Backus | 44.8 | 26.8 |
| 111006 Atopic Asthma-F | 8.2 | 1.1 | 104702 (SS) OA Synovium-Backus | 56.3 | 46.0 |
| 111417 Allergy-M | 33.2 | 27.7 | 117093 OA Cartilage Rep7 | 16.0 | 21.3 |
| 112347 Allergy-M | 2.1 | 0.3 | 112672 OA Bone5 | 27.2 | 10.4 |
| 112349 Normal Lung-F | 0.9 | 0.9 | 112673 OA Synovium5 | 4.5 | 0.8 |
| 112357 Normal Lung-F | 12.7 | 17.8 | 112674 OA Synovial Fluid cells5 | 7.2 | 8.0 |
| 112354 Normal Lung-M | 8.0 | 9.9 | 117100 OA Cartilage Rep14 | 8.3 | 7.2 |
| 112374 Crohns-F | 22.5 | 10.5 | 112756 OA Bone9 | 82.4 | 48.6 |
| 112389 Match Control Crohns-F | 63.7 | 57.8 | 112757 OA Synovium9 | 15.1 | 9.7 |
| 112375 Crohns-F | 24.8 | 18.3 | 112758 OA Synovial Fluid Cells9 | 1.1 | 10.6 |
| 112732 Match Control Crohns-F | 17.3 | 30.1 | 117125 RA Cartilage Rep2 | 0.0 | 3.8 |
| 112725 Crohns-M | 0.8 | 5.1 | 113492 Bone2 RA | 4.6 | 6.8 |
| 112387 Match Control Crohns-M | 32.1 | 7.6 | 113493 Synovium2 RA | 1.5 | 2.9 |
| 112378 Crohns-M | 1.6 | 0.9 | 113494 Syn Fluid Cells RA | 7.3 | 4.4 |
| 112390 Match Control Crohns-M | 73.2 | 66.9 | 113499 Cartilage4 RA | 2.1 | 3.4 |
| 112726 Crohns-M | 36.6 | 22.7 | 113500 Bone4 RA | 3.0 | 3.3 |
| 112731 Match Control Crohns-M | 30.6 | 24.0 | 113501 Synovium4 RA | 4.3 | 3.6 |
| 112380 Ulcer Col-F | 16.3 | 19.6 | 113502 Syn Fluid Cells4 RA | 2.1 | 2.5 |
| 112734 Match Control Ulcer Col-F | 30.8 | 30.4 | 113495 Cartilage3 RA | 5.7 | 4.1 |
| 112384 Ulcer Col-F | 65.5 | 71.7 | 113496 Bone3 RA | 2.1 | 3.0 |
| 112737 Match Control Ulcer Col-F | 32.3 | 0.0 | 113497 Synovium3 RA | 2.3 | 0.0 |
| 112386 Ulcer Col-F | 2.0 | 7.1 | 113498 Syn Fluid Cells3 RA | 1.2 | 6.3 |
| 112738 Match Control Ulcer Col-F | 1.1 | 0.0 | 117106 Normal Cartilage Rep20 | 4.9 | 9.2 |

TABLE 21B-continued

AI_comprehensive panel_v1.0

| Tissue Name | Rel. Exp.(%) Ag2255, Run 228157363 | Rel. Exp.(%) Ag2255, Run 228175007 | Tissue Name | Rel. Exp.(%) Ag2255, Run 228157363 | Rel. Exp.(%) Ag2255, Run 228175007 |
|---|---|---|---|---|---|
| 112381 Ulcer Col-M | 2.5 | 0.7 | 113663 Bone3 Normal | 4.5 | 2.1 |
| 112735 Match Control Ulcer Col-M | 9.5 | 7.6 | 113664 Synovium3 Normal | 0.7 | 0.4 |
| 112382 Ulcer Col-M | 50.0 | 48.6 | 113665 Syn Fluid Cells3 Normal | 0.5 | 0.3 |
| 112394 Match Control Ulcer Col-M | 1.1 | 0.0 | 117107 Normal Cartilage Rep22 | 2.0 | 4.5 |
| 112383 Ulcer Col-M | 30.8 | 45.7 | 113667 Bone4 Normal | 14.4 | 11.4 |
| 112736 Match Control Ulcer Col-M | 69.3 | 40.3 | 113668 Synovium4 Normal | 19.8 | 13.0 |
| 112423 Psoriasis-F | 11.0 | 10.4 | 113669 Syn Fluid Cells4 Normal | 36.9 | 33.7 |

TABLE 21C

Panel 1.3D

| Tissue Name | Rel. Exp.(%) Ag2255, Run 148399930 | Rel. Exp.(%) Ag2255, Run 148492532 | Tissue Name | Rel. Exp.(%) Ag2255, Run 148399930 | Rel. Exp.(%) Ag2255, Run 148492532 |
|---|---|---|---|---|---|
| Liver adenocarcinoma | 0.9 | 0.8 | Kidney (fetal) | 0.4 | 0.7 |
| Pancreas | 0.2 | 0.0 | Renal ca. 786-0 | 0.0 | 0.0 |
| Pancreatic ca. CAPAN 2 | 0.0 | 0.0 | Renal ca. A498 | 0.0 | 0.0 |
| Adrenal gland | 0.4 | 0.4 | Renal ca. RXF 393 | 0.0 | 0.0 |
| Thyroid | 0.7 | 0.4 | Renal ca. ACHN | 0.0 | 0.0 |
| Salivary gland | 0.2 | 0.6 | Renal ca. UO-31 | 0.0 | 0.0 |
| Pituitary gland | 0.3 | 0.1 | Renal ca. TK-10 | 0.0 | 0.0 |
| Brain (fetal) | 1.0 | 0.3 | Liver | 0.0 | 0.0 |
| Brain (whole) | 1.7 | 0.3 | Liver (fetal) | 0.0 | 0.0 |
| Brain (amygdala) | 0.2 | 0.3 | Liver ca. (hepatoblast) HepG2 | 0.0 | 0.0 |
| Brain (cerebellum) | 1.4 | 0.8 | Lung | 0.0 | 0.9 |
| Brain (hippocampus) | 2.0 | 1.9 | Lung (fetal) | 2.6 | 1.7 |
| Brain (substantia nigra) | 1.3 | 0.0 | Lung ca. (small cell) LX-1 | 26.4 | 24.0 |
| Brain (thalamus) | 1.6 | 1.2 | Lung ca. (small cell) NCI-H69 | 2.2 | 2.0 |
| Cerebral Cortex | 1.4 | 1.6 | Lung ca. (s.cell var.) SHP-77 | 0.2 | 0.4 |
| Spinal cord | 0.8 | 0.4 | Lung ca. (large cell) NCI-H460 | 1.1 | 1.7 |
| glio/astro U87-MG | 0.0 | 0.0 | Lung ca. (non-sm. cell) A549 | 0.2 | 0.0 |
| glio/astro U-118-MG | 0.0 | 0.0 | Lung ca. (non-s.cell) NCI-H23 | 1.4 | 1.4 |
| astrocytoma SW1783 | 0.0 | 0.0 | Lung ca. (non-s.cell) HOP-62 | 0.0 | 0.1 |
| neuro*; met SK-N-AS | 0.3 | 0.0 | Lung ca. (non-s.cl) NCI-H522 | 0.0 | 0.0 |
| astrocytoma SF-539 | 0.0 | 0.0 | Lung ca. (squam.) SW 900 | 0.0 | 0.0 |
| astrocytoma SNB-75 | 0.0 | 0.0 | Lung ca. (squam.) NCI-H596 | 0.3 | 0.2 |
| glioma SNB-19 | 0.0 | 0.0 | Mammary gland | 2.6 | 3.2 |
| glioma U251 | 0.0 | 0.0 | Breast ca.* (pl.ef) MCF-7 | 0.0 | 0.0 |
| glioma SF-295 | 0.0 | 0.0 | Breast ca.* (pl.ef) MDA-MB-231 | 0.0 | 0.0 |

TABLE 21C-continued

Panel 1.3D

| Tissue Name | Rel. Exp.(%) Ag2255, Run 148399930 | Rel. Exp.(%) Ag2255, Run 148492532 | Tissue Name | Rel. Exp.(%) Ag2255, Run 148399930 | Rel. Exp.(%) Ag2255, Run 148492532 |
|---|---|---|---|---|---|
| Heart (fetal) | 0.9 | 0.4 | Breast ca.* (Pl.ef) T47D | 0.0 | 0.0 |
| Heart | 0.0 | 0.2 | Breast ca. BT-549 | 0.0 | 0.0 |
| Skeleltal muscle (fetal) | 100.0 | 100.0 | Breast ca. MDA-N | 0.0 | 0.0 |
| Skeletal muscle | 0.2 | 0.2 | Ovary | 2.5 | 2.3 |
| Bone marrow | 0.0 | 0.0 | Ovarian ca. OVCAR-3 | 0.0 | 0.0 |
| Thymus | 0.5 | 0.1 | Ovarian ca. OVCAR-4 | 0.0 | 0.0 |
| Spleen | 0.0 | 0.0 | Ovarian ca. OVCAR-5 | 0.0 | 0.0 |
| Lymph node | 0.1 | 0.3 | Ovarian ca. OVCAR-8 | 0.2 | 0.2 |
| Colorectal | 0.4 | 0.0 | Ovarian ca. IGROV-1 | 0.0 | 0.0 |
| Stomach | 0.2 | 0.7 | Ovarian ca.* (ascites) SK-OV-3 | 0.0 | 0.0 |
| Small intestine | 0.4 | 0.8 | Uterus | 1.4 | 1.3 |
| Colon ca. SW480 | 0.4 | 0.9 | Placenta | 7.4 | 6.8 |
| Colon ca.* SW620 (SW480 met) | 13.2 | 17.3 | Prostate | 3.1 | 2.8 |
| Colon ca. HT29 | 0.0 | 0.0 | Prostate ca.* (bone met) PC-3 | 0.4 | 0.0 |
| Colon ca. HCT-116 | 0.0 | 0.4 | Testis | 0.8 | 0.3 |
| Colon ca. CaCo-2 | 0.9 | 0.7 | Melanoma Hs688(A).T | 0.0 | 0.0 |
| Colon ca. tissue (ODO3866) | 0.1 | 0.6 | Melanoma* (met) Hs688(B).T | 0.3 | 0.4 |
| Colon ca. HCC-2998 | 0.0 | 0.0 | Melanoma UACC-62 | 0.0 | 0.0 |
| Gastric ca.* (liver met) NCI-N87 | 0.0 | 0.0 | Melanoma M14 | 0.0 | 0.0 |
| Bladder | 0.2 | 0.3 | Melanoma LOX IMVI | 0.3 | 0.0 |
| Trachea | 2.9 | 4.5 | Melanoma* (met) SK-MEL-5 | 0.1 | 0.0 |
| Kidney | 0.0 | 0.0 | Adipose | 1.5 | 1.4 |

TABLE 21D

Panel 2D

| Tissue Name | Rel. Exp.(%) Ag2255, Run 148399949 | Rel. Exp.(%) Ag2255, Run 148492562 | Tissue Name | Rel. Exp.(%) Ag2255, Run 148399949 | Rel. Exp.(%) Ag2255, Run 148492562 |
|---|---|---|---|---|---|
| Normal Colon | 9.1 | 13.9 | Kidney Margin 8120608 | 0.0 | 0.0 |
| CC Well to Mod Diff (ODO3866) | 3.3 | 2.0 | Kidney Cancer 8120613 | 0.0 | 0.0 |
| CC Margin (ODO3866) | 2.4 | 2.0 | Kidney Margin 8120614 | 1.9 | 0.4 |
| CC Gr.2 rectosigmoid (ODO3868) | 0.8 | 1.9 | Kidney Cancer 9010320 | 1.4 | 0.8 |
| CC Margin (ODO3868) | 0.0 | 0.5 | Kidney Margin 9010321 | 0.4 | 0.0 |
| CC Mod Diff (ODO3920) | 0.0 | 0.5 | Normal Uterus | 2.1 | 1.3 |
| CC Margin (ODO3920) | 0.4 | 0.8 | Uterus Cancer 064011 | 100.0 | 85.3 |
| CC Gr.2 ascend colon (ODO3921) | 3.8 | 4.3 | Normal Thyroid | 5.2 | 8.4 |
| CC Margin (ODO3921) | 2.3 | 2.9 | Thyroid Cancer 064010 | 1.0 | 0.4 |

TABLE 21D-continued

Panel 2D

| Tissue Name | Rel. Exp.(%) Ag2255, Run 148399949 | Rel. Exp.(%) Ag2255, Run 148492562 | Tissue Name | Rel. Exp.(%) Ag2255, Run 148399949 | Rel. Exp.(%) Ag2255, Run 148492562 |
|---|---|---|---|---|---|
| CC from Partial Hepatectomy (ODO4309) Mets | 0.4 | 0.0 | Thyroid Cancer A302152 | 0.7 | 1.4 |
| Liver Margin (ODO4309) | 0.0 | 0.0 | Thyroid Margin A302153 | 0.3 | 1.9 |
| Colon mets to lung (OD04451-01) | 0.0 | 0.4 | Normal Breast | 5.1 | 3.4 |
| Lung Margin (OD04451-02) | 3.3 | 2.8 | Breast Cancer (OD04566) | 1.1 | 2.4 |
| Normal Prostate 6546-1 | 15.8 | 29.1 | Breast Cancer (OD04590-01) | 1.8 | 3.8 |
| Prostate Cancer (OD04410) | 3.4 | 7.2 | Breast Cancer Mets (OD04590-03) | 8.5 | 12.2 |
| Prostate Margin (OD04410) | 17.1 | 15.7 | Breast Cancer Metastasis (OD04655-05) | 0.9 | 1.0 |
| Prostate Cancer (OD04720-01) | 26.2 | 51.4 | Breast Cancer 064006 | 7.5 | 6.1 |
| Prostate Margin (OD04720-02) | 61.1 | 69.7 | Breast Cancer 1024 | 13.3 | 12.1 |
| Normal Lung 061010 | 13.5 | 15.4 | Breast Cancer 9100266 | 3.2 | 4.5 |
| Lung Met to Muscle (ODO4286) | 1.6 | 3.8 | Breast Margin 9100265 | 7.0 | 6.2 |
| Muscle Margin (ODO4286) | 1.6 | 2.3 | Breast Cancer A209073 | 10.7 | 15.6 |
| Lung Malignant Cancer (OD03126) | 28.9 | 29.5 | Breast Margin A2090734 | 9.0 | 11.7 |
| Lung Margin (OD03126) | 8.7 | 7.9 | Normal Liver | 0.0 | 0.0 |
| Lung Cancer (OD04404) | 92.7 | 100.0 | Liver Cancer 064003 | 0.3 | 0.0 |
| Lung Margin (OD04404) | 9.0 | 9.0 | Liver Cancer 1025 | 0.0 | 0.0 |
| Lung Cancer (OD04565) | 9.7 | 7.0 | Liver Cancer 1026 | 1.5 | 0.4 |
| Lung Margin (OD04565) | 1.6 | 0.8 | Liver Cancer 6004-T | 0.0 | 0.0 |
| Lung Cancer (OD04237-01) | 2.8 | 0.9 | Liver Tissue 6004-N | 0.2 | 0.0 |
| Lung Margin (OD04237-02) | 6.0 | 10.7 | Liver Cancer 6005-T | 0.5 | 0.0 |
| Ocular Mel Met to Liver (ODO4310) | 0.0 | 0.8 | Liver Tissue 6005-N | 0.0 | 0.0 |
| Liver Margin (ODO4310) | 0.0 | 0.0 | Normal Bladder | 1.4 | 0.8 |
| Melanoma Mets to Lung (OD04321) | 0.0 | 0.0 | Bladder Cancer 1023 | 1.4 | 0.0 |
| Lung Margin (OD04321) | 4.0 | 7.2 | Bladder Cancer A302173 | 7.5 | 12.1 |
| Normal Kidney | 2.7 | 1.8 | Bladder Cancer (OD04718-01) | 0.3 | 2.1 |
| Kidney Ca, Nuclear grade 2 (OD04338) | 0.6 | 1.3 | Bladder Normal Adjacent (OD04718-03) | 2.1 | 3.5 |
| Kidney Margin (OD04338) | 2.2 | 3.9 | Normal Ovary | 8.4 | 6.0 |
| Kidney Ca Nuclear grade 1/2 (OD04339) | 0.0 | 0.0 | Ovarian Cancer 064008 | 37.6 | 31.2 |
| Kidney Margin (OD04339) | 0.0 | 0.9 | Ovarian Cancer (OD04768-07) | 1.5 | 1.4 |
| Kidney Ca, Clear cell type (OD04340) | 0.6 | 0.0 | Ovary Margin (OD04768-08) | 5.3 | 5.3 |
| Kidney Margin (OD04340) | 1.0 | 0.5 | Normal Stomach | 1.8 | 3.3 |
| Kidney Ca, Nuclear grade 3 (OD04348) | 1.2 | 1.7 | Gastric Cancer 9060358 | 3.8 | 2.0 |
| Kidney Margin (OD04348) | 0.8 | 0.4 | Stomach Margin 9060359 | 1.9 | 1.4 |
| Kidney Cancer (OD04622-01) | 0.8 | 0.8 | Gastric Cancer 9060395 | 11.3 | 12.2 |

TABLE 21D-continued

Panel 2D

| Tissue Name | Rel. Exp.(%) Ag2255, Run 148399949 | Rel. Exp.(%) Ag2255, Run 148492562 | Tissue Name | Rel. Exp.(%) Ag2255, Run 148399949 | Rel. Exp.(%) Ag2255, Run 148492562 |
|---|---|---|---|---|---|
| Kidney Margin (OD04622-03) | 0.4 | 0.8 | Stomach Margin 9060394 | 2.9 | 3.5 |
| Kidney Cancer (OD04450-01) | 0.4 | 0.0 | Gastric Cancer 9060397 | 2.4 | 5.4 |
| Kidney Margin (OD04450-03) | 0.5 | 0.7 | Stomach Margin 9060396 | 1.9 | 3.0 |
| Kidney Cancer 8120607 | 0.6 | 1.4 | Gastric Cancer 064005 | 4.8 | 5.3 |

TABLE 21E

Panel 3D

| Tissue Name | Rel. Exp. (%) Ag2255, Run 170745120 | Tissue Name | Rel. Exp. (%) Ag2255, Run 170745120 |
|---|---|---|---|
| Daoy- Medulloblastoma | 0.0 | Ca Ski- Cervical epidermoid carcinoma (metastasis) | 1.6 |
| TE671- Medulloblastoma | 0.0 | ES-2- Ovarian clear cell carcinoma | 0.0 |
| D283 Med- Medulloblastoma | 0.0 | Ramos- Stimulated with PMA/ionomycin 6 h | 0.0 |
| PFSK-1- Primitive Neuroectodermal | 0.0 | Ramos- Stimulated with PMA/ionomycin 14 h | 0.0 |
| XF-498- CNS | 0.0 | MEG-01- Chronic myelogenous leukemia (megokaryoblast) | 0.0 |
| SNB-78- Glioma | 0.0 | Raji- Burkitt's lymphoma | 0.0 |
| SF-268- Glioblastoma | 0.0 | Daudi- Burkitt's lymphoma | 0.0 |
| T98G- Glioblastoma | 0.0 | U266- B-cell plasmacytoma | 0.0 |
| SK-N-SH- Neuroblastoma (metastasis) | 0.0 | CA46- Burkitt's lymphoma | 0.0 |
| SF-295- Glioblastoma | 0.0 | RL- non-Hodgkin's B-cell lymphoma | 0.0 |
| Cerebellum | 4.8 | JM1- pre-B-cell lymphoma | 0.0 |
| Cerebellum | 8.2 | Jurkat- T cell leukemia | 0.0 |
| NCI-H292- Mucoepidermoid lung carcinoma | 17.4 | TF-1- Erythroleukemia | 0.0 |
| DMS-114- Small cell lung cancer | 7.9 | HUT 78- T-cell lymphoma | 0.0 |
| DMS-79- Small cell lung cancer | 0.0 | U937- Histiocytic lymphoma | 0.0 |
| NCI-H146- Small cell lung cancer | 16.7 | KU-812- Myelogenous leukemia | 0.0 |
| NCI-H526- Small cell lung cancer | 12.3 | 769-P- Clear cell renal carcinoma | 0.0 |
| NCI-N417- Small cell lung cancer | 0.0 | Caki-2- Clear cell renal carcinoma | 0.0 |
| NCI-H82- Small cell lung cancer | 0.9 | SW 839- Clear cell renal carcinoma | 0.0 |
| NCI-H157- Squamous cell lung cancer (metastasis) | 0.0 | G401- Wilms' tumor | 0.0 |
| NCI-H1155- Large cell lung cancer | 0.0 | Hs766T- Pancreatic carcinoma (LN metastasis) | 0.0 |
| NCI-H1299- Large cell lung cancer | 0.0 | CAPAN-1- Pancreatic adenocarcinoma (liver metastasis) | 0.0 |
| NCI-H727- Lung carcinoid | 94.6 | SU86.86- Pancreatic carcinoma (liver metastasis) | 0.0 |
| NCI-UMC-11- Lung carcinoid | 34.9 | BxPC-3- Pancreatic adenocarcinoma | 0.0 |
| LX-1- Small cell lung cancer | 100.0 | HPAC- Pancreatic adenocarcinoma | 0.0 |
| Colo-205-Colon cancer | 18.4 | MIA PaCa-2-Pancreatic carcinoma | 0.0 |
| KM12- Colon cancer | 0.0 | CFPAC-1- Pancreatic ductal adenocarcinoma | 9.0 |
| KM20L2- Colon cancer | 0.0 | PANC-1- Pancreatic epithelioid ductal carcinoma | 0.0 |
| NCI-H716- Colon cancer | 0.0 | T24- Bladder carcinoma (transitional cell) | 0.0 |
| SW-48- Colon adenocarcinoma | 71.7 | 5637- Bladder carcinoma | 0.5 |

TABLE 21E-continued

Panel 3D

| Tissue Name | Rel. Exp. (%) Ag2255, Run 170745120 | Tissue Name | Rel. Exp. (%) Ag2255, Run 170745120 |
|---|---|---|---|
| SW1116- Colon adenocarcinoma | 8.5 | HT-1197- Bladder carcinoma | 0.0 |
| LS 174T- Colon adenocarcinoma | 0.0 | UM-UC-3- Bladder carcinoma (transitional cell) | 0.0 |
| SW-948- Colon adenocarcinoma | 0.0 | A204- Rhabdomyosarcoma | 0.0 |
| SW-480- Colon adenocarcinoma | 0.0 | HT-1080- Fibrosarcoma | 0.0 |
| NCI-SNU-5- Gastric carcinoma | 0.0 | MG-63- Osteosarcoma | 0.0 |
| KATO III- Gastric carcinoma | 0.0 | SK-LMS-1- Leiomyosarcoma (vulva) | 0.0 |
| NCI-SNU-16- Gastric carcinoma | 0.0 | SJRH30- Rhabdomyosarcoma (met to bone marrow) | 0.0 |
| NCI-SNU-1- Gastric carcinoma | 0.0 | A431- Epidermoid carcinoma | 21.6 |
| RF-1- Gastric adenocarcinoma | 0.0 | WM266-4- Melanoma | 0.0 |
| RF-48- Gastric adenocarcinoma | 0.0 | DU 145- Prostate carcinoma (brain metastasis) | 0.0 |
| MKN-45- Gastric carcinoma | 0.0 | MDA-MB-468- Breast adenocarcinoma | 0.0 |
| NCI-N87- Gastric carcinoma | 0.0 | SCC-4- Squamous cell carcinoma of tongue | 0.0 |
| OVCAR-5- Ovarian carcinoma | 0.0 | SCC-9- Squamous cell carcinoma of tongue | 0.0 |
| RL95-2- Uterine carcinoma | 62.0 | SCC-15- Squamous cell carcinoma of tongue | 0.0 |
| HelaS3- Cervical adenocarcinoma | 41.2 | CAL 27- Squamous cell carcinoma of tongue | 0.0 |

TABLE 21F

Panel 4D

| Tissue Name | Rel. Exp.(%) Ag2255, Run 148492583 | Rel. Exp.(%) Ag2255, Run 152572164 | Tissue Name | Rel. Exp.(%) Ag2255, Run 148492583 | Rel. Exp.(%) Ag2255, Run 152572164 |
|---|---|---|---|---|---|
| Secondary Th1 act | 0.0 | 0.0 | HUVEC IL-1 beta | 0.0 | 0.0 |
| Secondary Th2 act | 0.0 | 0.0 | HUVEC IFN gamma | 0.0 | 0.0 |
| Secondary Tr1 act | 0.4 | 0.0 | HUVEC TNF alpha + IFN gamma | 0.0 | 0.0 |
| Secondary Th1 rest | 0.0 | 0.0 | HUVEC TNF alpha + IL4 | 0.0 | 0.0 |
| Secondary Th2 rest | 0.3 | 0.8 | HUVEC IL-11 | 0.0 | 0.0 |
| Secondary Tr1 rest | 0.0 | 0.0 | Lung Microvascular EC none | 0.0 | 0.0 |
| Primary Th1 act | 0.0 | 0.0 | Lung Microvascular EC TNFalpha + IL-1 beta | 0.0 | 0.0 |
| Primary Th2 act | 0.0 | 0.0 | Microvascular Dermal EC none | 0.0 | 0.3 |
| Primary Tr1 act | 0.0 | 0.0 | Microvascular Dermal EC TNFalpha + IL-1 beta | 0.0 | 0.0 |
| Primary Th1 rest | 0.0 | 0.0 | Bronchial epithelium TNFalpha + IL1 beta | 1.4 | 0.3 |
| Primary Th2 rest | 0.0 | 0.0 | Small airway epithelium none | 0.6 | 1.2 |
| Primary Tr1 rest | 0.0 | 0.0 | Small airway epithelium TNFalpha + IL-1 beta | 3.6 | 3.0 |
| CD45RA CD4 lymphocyte act | 0.0 | 0.0 | Coronery artery SMC rest | 0.0 | 0.0 |
| CD45RO CD4 lymphocyte act | 0.0 | 0.0 | Coronery artery SMC TNFalpha + IL-1 beta | 0.8 | 0.0 |
| CD8 lymphocyte act | 0.0 | 0.0 | Astrocytes rest | 0.0 | 0.0 |
| Secondary CD8 lymphocyte rest | 0.0 | 0.0 | Astrocytes TNFalpha + IL-1 beta | 0.0 | 0.0 |

TABLE 21F-continued

Panel 4D

| Tissue Name | Rel. Exp.(%) Ag2255, Run 148492583 | Rel. Exp.(%) Ag2255, Run 152572164 | Tissue Name | Rel. Exp.(%) Ag2255, Run 148492583 | Rel. Exp.(%) Ag2255, Run 152572164 |
|---|---|---|---|---|---|
| Secondary CD8 lymphocyte act | 0.0 | 0.0 | KU-812 (Basophil) rest | 0.0 | 0.0 |
| CD4 lymphocyte none | 0.0 | 0.0 | KU-812 (Basophil) PMA/ionomycin | 0.0 | 0.0 |
| 2ry Th1/Th2/Tr1_anti-CD95 CH11 | 0.0 | 0.0 | CCD1106 (Keratinocytes) none | 17.2 | 14.0 |
| LAK cells rest | 0.6 | 0.0 | CCD1106 (Keratinocytes) TNFalpha + IL-1 beta | 2.4 | 0.8 |
| LAK cells IL-2 | 0.0 | 0.0 | Liver cirrhosis | 2.4 | 2.4 |
| LAK cells IL-2 + IL-12 | 0.0 | 0.0 | Lupus kidney | 0.0 | 0.0 |
| LAK cells IL-2 + IFN gamma | 0.0 | 0.0 | NCI-H292 none | 12.2 | 14.2 |
| LAK cells IL-2 + IL-18 | 0.0 | 0.0 | NCI-H292 IL-4 | 100.0 | 100.0 |
| LAK cells PMA/ionomycin | 0.0 | 0.0 | NCI-H292 IL-9 | 11.3 | 14.3 |
| NK Cells IL-2 rest | 0.0 | 0.0 | NCI-H292 IL-13 | 47.3 | 65.5 |
| Two Way MLR 3 day | 0.0 | 0.0 | NCI-H292 IFN gamma | 8.1 | 8.1 |
| Two Way MLR 5 day | 0.0 | 0.0 | HPAEC none | 0.0 | 0.0 |
| Two Way MLR 7 day | 0.0 | 0.0 | HPAEC TNF alpha + IL-1 beta | 0.0 | 0.0 |
| PBMC rest | 0.0 | 0.0 | Lung fibroblast none | 0.0 | 0.0 |
| PBMC PWM | 0.0 | 0.0 | Lung fibroblast TNF alpha + IL-1 beta | 0.0 | 0.0 |
| PBMC PHA-L | 0.0 | 0.4 | Lung fibroblast IL-4 | 0.0 | 0.0 |
| Ramos (B cell) none | 0.0 | 0.0 | Lung fibroblast IL-9 | 0.0 | 0.0 |
| Ramos (B cell) ionomycin | 0.0 | 0.0 | Lung fibroblast IL-13 | 0.2 | 0.0 |
| B lymphocytes PWM | 0.0 | 0.4 | Lung fibroblast IFN gamma | 0.0 | 0.0 |
| B lymphocytes CD40L and IL-4 | 0.2 | 0.3 | Dermal fibroblast CCD1070 rest | 0.0 | 0.3 |
| EOL-1 dbcAMP | 0.0 | 0.0 | Dermal fibroblast CCD1070 TNF alpha | 0.0 | 0.0 |
| EOL-1 dbcAMP PMA/ionomycin | 0.4 | 0.0 | Dermal fibroblast CCD1070 IL-1 beta | 0.0 | 0.0 |
| Dendritic cells none | 0.0 | 0.0 | Dermal fibroblast IFN gamma | 0.3 | 0.0 |
| Dendritic cells LPS | 0.0 | 0.0 | Dermal fibroblast IL-4 | 2.1 | 0.3 |
| Dendritic cells anti-CD40 | 0.0 | 0.0 | IBD Colitis 2 | 0.7 | 0.4 |
| Monocytes rest | 0.0 | 0.0 | IBD Crohn's | 0.3 | 0.0 |
| Monocytes LPS | 0.0 | 0.4 | Colon | 6.1 | 6.3 |
| Macrophages rest | 0.0 | 0.0 | Lung | 9.7 | 15.2 |
| Macrophages LPS | 0.0 | 0.0 | Thymus | 1.6 | 0.9 |
| HUVEC none | 0.0 | 0.0 | Kidney | 1.5 | 1.7 |
| HUVEC starved | 0.0 | 0.0 | | | |

AI_comprehensive panel_v1.0 Summary: Ag2255 Two experiments with the same probe and primer set both show highest expression of the CG50379-01 gene, a Frizzled-10 homolog, in samples from a subset of emphysema patients (CTs=31–32). In addition, this gene is also expressed at moderate levels in samples from the mucoepidermoid pulmonary epithelial cell line NCI-H292 activated with IL-4 or IL-13 in culture. Based on this expression profile, small molecule drugs or antibodies that antagonize the action of the putative 7-transmembrane receptor encoded by the CG50379-01 gene may be useful as therapeutics which reduce or eliminate the symptoms in patients with allergy, asthma, or chronic obstructive pulmonary diseases.

Panel 1.3D Summary: Ag2255 Two experiments with the same probe and primer set both show highest expression of the CG50379-01 gene, a Frizzled-10 homolog, in samples derived from fetal skeletal muscle (CTs=29–30). Furthermore, expression in fetal skeletal muscle is significantly higher than in adult skeletal muscle (CTs=38). Thus, expression of this gene could be used to differentiate between fetal and adult skeletal muscle. In addition, the significantly higher levels of expression in fetal skeletal muscle suggest that this gene product may enhance muscular growth or development in the fetus and thus may also act in a regenerative capacity in the adult. Therefore, therapeutic modulation of the protein encoded by this gene could be useful in treatment of muscle related diseases. More specifically, treatment of weak or dystrophic muscle with the protein encoded by this gene could restore muscle mass or function.

The CG50379-01 gene is also expressed in small cell lung cancer and colon carcinoma. Therefore, expression of this gene could be used to differentiate between these samples and other samples on this panel. Furthermeore, therapeutic targeting of FZD10 with a monoclonal antibody is anticipated to limit or block the extent of tumor cell migration, invasion and growth, specifically in lung and colon tumors.

References:

Koike J, Takagi A, Miwa T, Hirai M, Terada M, Katoh M Molecular cloning of Frizzled-10, a novel member of the Frizzled gene family. Biochem Biophys Res Commun Aug. 19, 1999;262(1):39–43

In the above reference, the Frizzled genes are found to encode WNT receptors. Frizzled-10 (FZD10) was cloned and characterized. Nucleotide sequence analysis showed that human FZD10 gene encodes a seven-transmembrane-receptor of 581 amino acids, with an N-terminal cysteine-rich domain and a C-terminal Ser/Thr-Xxx-Val motif. Larger amounts of FZD10 mRNA, 4.0 kb in size, were detected in the placenta and fetal kidney, followed by fetal lung and brain. In adult brain, FZD10 mRNA was abundant in the cerebellum. Among cancer cell lines, FZD10 was highly expressed in a cervical cancer cell line, HeLa S3, and moderately in a colon cancer cell line, SW480. The FZD10 gene was mapped to human chromosome 12q24.33.

Kawakami Y, Wada N, Nishimatsu S, Nohno T Involvement of frizzled-10 in Wnt-7a signaling during chick limb development. Dev Growth Differ 2000 December;42(6):561–9

Abstract: The dorsal ectoderm of the limb bud is known to regulate anterior-posterior patterning as well as dorsal-ventral patterning during vertebrate limb morphogenesis. Wnt-7a, expressed in the dorsal ectoderm, encodes a key molecule implicated in these events. In the present study, chicken frizzled-10 (Fz-10) encoding a Wnt receptor was used to study mechanisms of Wnt-7a signaling during chick limb patterning, because its expression is restricted to the posterior-distal region of the dorsal limb bud. Fz-10 transcripts colocalize with Sonic hedgehog (Shh) in the dorsal side of stages 18–23 chick limb buds. It was demonstrated that Fz-10 interacts with Wnt-7a to induce synergistically the expression of Wnt-responsive genes, such as Siamois and Xnr3, in Xenopus animal cap assays. In the chick limb bud, Fz-10 expression is regulated by Shh and a signal from the dorsal ectoderm, presumably Wnt-7a, but not by signals from the apical ectodermal ridge. These results suggest that Fz-10 acts as a receptor for Wnt-7a and has a positive effect on Shh expression in the chick limb bud.

Panel 2D Summary: Ag2255 Two experiments with the same probe and primer set both show highest expression of the CG50379-01 gene, a Frizzled-10 homolog, in samples derived from uterine and lung cancer (CTs=30–31). Significant expression is also seen in prostate cancer. In addition, this gene is overexpressed in uterine, lung and gastric tumors compared with their normal adjacent tissue. Therefore, therapeutic targeting of FZD10 with a monoclonal antibody is anticipated to limit or block the extent of tumor cell migration, invasion and growth, preferably in lung, uterine, prostate, gastric and ovarian tumors.

Panel 3D Summary: Ag2255 The expression of the CG50379-01 gene appears to be highest in a sample derived from a lung cancer cell line (LX-1)(CT=30.7). There also appears to be substantial expression in other lung cancer cell lines as well as colon cancer cell lines. This expression is consistent with the expression seen in Panel 1.3D. Thus, the expression of this gene could be used to distinguish LX-1 samples from other samples in the panel. Moreover, therapeutic modulation of thie gene, through the use of small molecule drugs, antibodies or protein therapeutics might be beneficial in the treatment of lung or colon cancer.

Panel 4D Summary: Ag2255 Two experiments with the same probe and primer set both show highest expression of the CG50379-01 gene, a Frizzled-10 homolog, in samples derived from the pulmonary mucoepidermoid cell line NCI-H292 stimulated with IL-4 (CTs=30). Significant expression is also seen in IL-13 activated NCI-H292. This prominent expression in lung-derived tissue is consistent with the previous panels and particularly expression in this cell line is consistent with the expression in AI_comprehensive panel_v1.0. Thus, this expression profile indicates that this gene product may play a key role as a mediator of inflammation, especially in late-phase allergic reactions, and as a mediator of local cellular movement or trafficking into the inflamed area by cytokines and chemokines. Therefore, therapeutic targeting of CG50379-01 with a monoclonal antibody or small molecule drug that antagonize the action of this 7-membrane receptor homolog is anticipated to limit or block the extent of inflammation potential and thus the symptoms, caused by pro-inflammatory cytokines such as IL-4 or IL-13, when these cytokines are induced in allergic, asthma and COPD patients.

References:

Louahed J, Toda M, Jen J, Hamid Q, Renauld J C, Levitt R C, Nicolaides N C Interleukin-9 upregulates mucus expression in the airways. Am J Respir Cell Mol Biol 2000 June;22(6):649–56

Abstract: Interleukin (IL)-9 has recently been shown to play an important role in allergic disease because its expression is strongly associated with the degree of airway responsiveness and the asthmatic-like phenotype. IL-9 is a pleiotropic cytokine that is active on many cell types involved in the allergic immune response. Mucus hypersecretion is a clinical feature of chronic airway diseases; however, the mechanisms underlying the induction of mucin are poorly understood. In this report, it is shown that IL-9 regulates the expression of a subset of mucin genes in lung cells both in vivo and in vitro. In vivo, the constitutive expression of IL-9 in transgenic mice results in elevated MUC2 and MUCC5AC gene expression in airway epithelial cells and periodic acid-Schiff-positive staining (reflecting mucous glycogenates). Similar results were observed in C57BL/6J mice after IL-9 intratracheal instillation. In contrast, instillation of the T helper 1-associated cytokine interferon gamma failed to induce mucin production. In vitro, our studies showed that IL-9 also induces expression of MUC2 and MUC5AC in human primary lung cultures and in the human muccoepidermoid NCI-H292 cell line, indicating a direct effect of IL-9 on inducing mucin expression in these cells. Altogether, these results suggest that upregulation of mucin by IL-9 might contribute to the pathogenesis of human inflammatory airway disorders, such as asthma. These data extend the role of the biologic processes that IL-9 has on regulating the many clinical features of asthma and further supports the IL-9 pathway as a key mediator of the asthmatic response.

Zheng T, Zhu z, Wang Z, Homer R J, Ma B, Riese R J Jr, Chapman H A J, Shapiro S D, Elias J A Inducible targeting of IL-13 to the adult lung cancer matrix metalloproteinase- and cathepsin-dependent emphysema. J Clin Invest 2000 November;106(9):1081–93

Abstract: Cigarette smoke exposure is the major cause of chronic obstructive pulmonary disease (COPD). However, only aminority of smokers develop significant COPD, and patients with asthma or asthma-like airway hyperresponsiveness or eosinophilia experience accelerated loss of lung function after cigarette smoke exposure. Pulmonary inflammation is a characteristic feature of lungs from patients with COPD. Surprisingly, the mediators of this inflammation and their contributions to the pathogenesis and varied natural history of COPD are not well defined. Here it is shown that IL-13, a critical cytokine in asthma, causes emphysema with enhanced lung volumes and compliance, mucus metaplasia, and inflammation, when inducibly overexpressed in the adult murine lung. MMP-2, -9, -12, -13, and -14 and cathepsins B, S, L, H, and K were induced by IL-13 in this setting. In addition, treatment with MMP or cysteine proteinase antagonists significantly decreased the emphysema and inflammation, but not the mucus in these animals. These studies demonstrate that IL-13 is a potent stimulator of MMP and cathepsin-based proteolytic pathways in the lung. They also demonstrate that IL-13 causes emphysema via a MMP- and cathepsin-dependent mechanism(s) and highlight common mechanisms that may underlie COPD and asthma.

SEC4 (CG55023-01/SC46872089)

Expression of gene CG55023-01 was assessed using the primer-probe sets Ag692, Ag264 and Ag264b, described in Tables 22A, 22B and 22C. Results of the RTQ-PCR runs are shown in Tables 22D, 22E, 22F, 22G and 22H.

TABLE 22A

Probe Name Ag692

| Primers | Sequences | | Length | Start Position |
|---|---|---|---|---|
| Forward | 5'-cttgaagttctcacacctttgc-3' | (SEQ ID NO:144) | 22 | 207 |
| Probe | TET-5'-tcataacagttactgcatcaacggtg-3'-TAMRA | (SEQ ID NO:145) | 26 | 237 |
| Reverse | 5'-tcatggtggaatgcacaag-3' | (SEQ ID NO:146) | 19 | 263 |

TABLE 22B

Probe Name Ag264

| Primers | Sequences | | Length | Start Position |
|---|---|---|---|---|
| Forward | 5'-gtctatcttttattcaacgcaatgaca-3' | (SEQ ID NO:147) | 27 | 73 |
| Probe | TET-5'-agtcacggctgcctcttcggtca-3'-TAMRA | (SEQ ID NO:148) | 23 | 104 |
| Reverse | 5'-gggctgtgattggaggtgtt-3' | (SEQ ID NO:149) | 20 | 129 |

TABLE 22C

Probe Name Ag264b

| Primers | Sequences | | Length | Start Position |
|---|---|---|---|---|
| Forward | 5'-gtctatcttttattcaacgcaatgaca-3' | (SEQ ID NO.150) | 27 | 73 |
| Probe | TET-5'-cacggctgcctcttcggtcagtg-3'-TAMRA | (SEQ ID NO:151) | 23 | 101 |
| Reverse | 5'-gggctgtgattggaggtgtta-3' | (SEQ ID NO:152) | 21 | 128 |

TABLE 22D

CNS_neurodegeneration_v1.0

| Tissue Name | Rel. Exp. (%) Ag692, Run 224996549 | Tissue Name | Rel. Exp. (%) Ag692, Run 224996549 |
|---|---|---|---|
| AD 1 Hippo | 0.0 | Control (Path) 3 Temporal Ctx | 15.4 |
| AD 2 Hippo | 5.6 | Control (Path) 4 Temporal Ctx | 17.6 |
| AD 3 Hippo | 0.0 | AD 1 Occipital Ctx | 21.0 |
| AD 4 Hippo | 0.0 | AD 2 Occipital Ctx (Missing) | 0.0 |
| AD 5 hippo | 69.7 | AD 3 Occipital Ctx | 31.9 |
| AD 6 Hippo | 70.2 | AD 4 Occipital Ctx | 22.4 |
| Control 2 Hippo | 61.6 | AD 5 Occipital Ctx | 24.3 |
| Control 4 Hippo | 27.2 | AD 6 Occipital Ctx | 75.8 |
| Control (Path) 3 Hippo | 0.0 | Control 1 Occipital Ctx | 20.7 |
| AD 1 Temporal Ctx | 0.0 | Control 2 Occipital Ctx | 41.8 |
| AD 2 Temporal Ctx | 37.4 | Control 3 Occipital Ctx | 21.9 |
| AD 3 Temporal Ctx | 0.0 | Control 4 Occipital Ctx | 0.0 |

TABLE 22D-continued

CNS_neurodegeneration_v1.0

| Tissue Name | Rel. Exp. (%) Ag692, Run 224996549 | Tissue Name | Rel. Exp. (%) Ag692, Run 224996549 |
|---|---|---|---|
| AD 4 Temporal Ctx | 10.5 | Control (Path) 1 Occipital Ctx | 75.8 |
| AD 5 Inf Temporal Ctx | 81.2 | Control (Path) 2 Occipital Ctx | 0.0 |
| AD 5 SupTemporal Ctx | 92.7 | Control (Path) 3 Occipital Ctx | 0.0 |
| AD 6 Inf Temporal Ctx | 23.5 | Control (Path) 4 Occipital Ctx | 0.0 |
| AD 6 Sup Temporal Ctx | 69.3 | Control 1 Parietal Ctx | 30.8 |
| Control 1 Temporal Ctx | 66.0 | Control 2 Parietal Ctx | 42.6 |
| Control 2 Temporal Ctx | 44.8 | Control 3 Parietal Ctx | 18.3 |
| Control 3 Temporal Ctx | 0.0 | Control (Path) 1 Parietal Ctx | 53.6 |
| Control 4 Temporal Ctx | 21.2 | Control (Path) 2 Parietal Ctx | 22.2 |
| Control (Path) 1 Temporal Ctx | 64.2 | Control (Path) 3 Parietal Ctx | 0.0 |
| Control (Path) 2 Temporal Ctx | 100.0 | Control (Path) 4 Parietal Ctx | 25.5 |

TABLE 22E

Panel 1

| Tissue Name | Rel. Exp.(%) Ag264, Run 87590466 | Rel. Exp.(%) Ag264, Run 88794920 | Rel. Exp.(%) Ag264b, Run 97806010 | Tissue Name | Rel. Exp.(%) Ag264, Run 87590466 | Rel. Exp.(%) Ag264, Run 88794920 | Rel. Exp.(%) Ag264b, Run 97806010 |
|---|---|---|---|---|---|---|---|
| Endothelial cells | 0.0 | 0.0 | 2.5 | Renal ca. 786-0 | 0.0 | 0.0 | 2.4 |
| Endothelial cells (treated) | 0.0 | 0.0 | 2.6 | Renal ca A498 | 0.0 | 0.0 | 2.3 |
| Pancreas | 0.0 | 0.0 | 3.5 | Renal ca. RXF 393 | 0.0 | 0.0 | 3.1 |
| Pancreatic ca. CAPAN 2 | 0.0 | 0.0 | 2.2 | Renal ca. ACHN | 0.0 | 0.0 | 3.5 |
| Adrenal gland | 0.0 | 0.0 | 3.6 | Renal ca. UO-31 | 0.0 | 0.0 | 2.5 |
| Thyroid | 0.0 | 0.0 | 3.7 | Renal ca. TK-10 | 0.0 | 0.0 | 2.3 |
| Salivary gland | 0.0 | 0.0 | 2.8 | Liver | 0.0 | 0.0 | 2.6 |
| Pituitary gland | 0.0 | 0.0 | 2.4 | Liver (fetal) | 0.0 | 0.0 | 3.0 |
| Brain (fetal) | 0.0 | 0.0 | 3.2 | Liver ca (hepatoblast) HepG2 | 0.0 | 0.0 | 2.2 |
| Brain (whole) | 0.0 | 0.0 | 2.5 | Lung | 0.0 | 0.0 | 4.5 |
| Brain (amygdala) | 0.0 | 0.0 | 2.7 | Lung (fetal) | 0.0 | 0.0 | 3.4 |
| Brain (cerebellum) | 0.0 | 0.0 | 3.2 | Lung ca. (small cell) LX-1 | 0.0 | 0.0 | 3.0 |
| Brain (hippocampus) | 0.0 | 0.0 | 4.6 | Lung ca. (small cell) NCI-H69 | 0.0 | 0.0 | 2.4 |
| Brain (substantianigra) | 0.0 | 0.0 | 3.1 | Lung ca. (s.cell var.) SHP-77 | 0.0 | 0.0 | 2.0 |
| Brain (thalamus) | 0.0 | 0.0 | 4.0 | Lung ca. (large cell) NCI-H460 | 37.1 | 39.8 | 68.8 |
| Brain (hypothalamus) | 0.0 | 0.0 | 4.7 | Lung ca. (non-sm. cell) A549 | 0.0 | 0.0 | 2.1 |
| Spinal cord | 0.0 | 0.0 | 2.9 | Lung ca. (non-s.cell) NCI-H23 | 0.0 | 0.0 | 3.7 |
| glio/astro U87-MG | 0.0 | 0.0 | 3.3 | Lung ca. (non-s.cell) HOP-62 | 0.0 | 0.0 | 3.2 |
| glio/astro U-118-MG | 0.0 | 0.0 | 2.4 | Lung ca. (non-s.cl) NCI- | 0.0 | 0.0 | 2.9 |

TABLE 22E-continued

Panel 1

| Tissue Name | Rel. Exp.(%) Ag264, Run 87590466 | Rel. Exp.(%) Ag264, Run 88794920 | Rel. Exp.(%) Ag264b, Run 97806010 | Tissue Name | Rel. Exp.(%) Ag264, Run 87590466 | Rel. Exp.(%) Ag264, Run 88794920 | Rel. Exp.(%) Ag264b, Run 97806010 |
|---|---|---|---|---|---|---|---|
| astrocytoma SW1783 | 0.0 | 0.0 | 3.1 | Lung ca. (squam.) SW 900 H522 | 0.0 | 0.0 | 3.4 |
| neuro*; met SK-N-AS | 0.0 | 0.0 | 3.0 | Lung ca. (squam.) NCI-H596 | 0.0 | 0.0 | 2.9 |
| astrocytoma SF-539 | 0.0 | 0.0 | 2.3 | Mammary gland | 0.0 | 0.0 | 2.9 |
| astrocytoma SNB-75 | 0.0 | 0.0 | 2.6 | Breast ca.* (pl.ef) MCF-7 | 0.0 | 0.0 | 2.1 |
| glioma SNB-19 | 0.0 | 0.0 | 2.8 | Breast ca.* (pl.ef) MDA-MB-231 | 0.0 | 0.0 | 2.9 |
| glioma U251 | 0.0 | 0.0 | 2.1 | Breast ca.* (pl.ef) T47D | 0.0 | 0.0 | 3.8 |
| glioma SF-295 | 0.0 | 0.0 | 4.1 | Breast ca. BT-549 | 0.0 | 0.0 | 2.0 |
| Heart | 0.0 | 0.0 | 4.5 | Breast ca. MDA-N | 0.0 | 0.0 | 2.4 |
| Skeletal muscle | 0.0 | 0.0 | 2.8 | Ovary | 0.0 | 0.0 | 3.0 |
| Bone marrow | 0.0 | 0.0 | 2.8 | Ovarian ca. OVCAR-3 | 0.0 | 0.0 | 6.9 |
| Thymus | 0.0 | 0.0 | 4.6 | Ovarian ca. OVCAR-4 | 0.0 | 0.0 | 2.2 |
| Spleen | 0.0 | 0.0 | 2.2 | Ovarian ca. OVCAR-5 | 0.0 | 0.0 | 2.7 |
| Lymph node | 0.0 | 0.0 | 2.4 | Ovarian ca. OVCAR-8 | 0.0 | 0.0 | 3.0 |
| Colon (ascending) | 0.0 | 0.0 | 2.0 | Ovarian ca. IGROV-1 | 0.0 | 0.0 | 2.6 |
| Stomach | 0.0 | 0.0 | 3.6 | Ovarian ca. (ascites) SK-OV-3 | 0.0 | 0.0 | 2.8 |
| Small intestine | 0.0 | 0.0 | 2.5 | Uterus | 0.0 | 0.0 | 2.3 |
| Colon ca. SW480 | 0.0 | 0.0 | 2.4 | Placenta | 0.0 | 0.0 | 4.7 |
| Colon ca.* SW620 (SW480 met) | 0.0 | 0.0 | 2.7 | Prostate | 0.0 | 0.0 | 2.4 |
| Colon ca. HT29 | 0.0 | 0.0 | 2.5 | Prostate ca.* (bone met) PC-3 | 100.0 | 100.0 | 100.0 |
| Colon ca. HCT-116 | 0.0 | 0.0 | 2.8 | Testis | 0.0 | 10.0 | 5.3 |
| Colon ca. CaCo-2 | 0.0 | 0.0 | 4.0 | Melanoma Hs688(A).T | 0.0 | 0.0 | 2.4 |
| Colon ca. HCT-15 | 0.0 | 0.0 | 2.0 | Melanoma* (met) Hs688(B).T | 0.0 | 0.0 | 3.7 |
| Colon ca. HCC-2998 | 0.0 | 0.0 | 2.6 | Melanoma UACC-62 | 0.0 | 0.0 | 3.1 |
| Gastric ca.* (liver met) NCI-N87 | 0.0 | 0.0 | 3.1 | Melanoma M14 | 0.0 | 0.0 | 2.4 |
| Bladder | 0.0 | 0.0 | 2.8 | Melanoma LOX IMVI | 0.0 | 0.0 | 3.3 |
| Trachea | 0.0 | 0.0 | 2.7 | Melanoma* (met) SK-MEL-5 | 0.0 | 0.0 | 2.5 |
| Kidney | 0.0 | 0.0 | 2.4 | Melanoma SK-MEL-28 | 0.0 | 0.0 | 2.6 |
| Kidney (fetal) | 0.0 | 0.0 | 3.3 | | | | |

TABLE 22F

Panel 1.2

| Tissue Name | Rel. Exp.(%) Ag692, Run 114250175 | Rel. Exp.(%) Ag692, Run 117052376 | Tissue Name | Rel. Exp.(%) Ag692, Run 114250175 | Rel. Exp.(%) Ag692, Run 117052376 |
|---|---|---|---|---|---|
| Endothelial cells | 2.9 | 0.0 | Renal ca. 786-0 | 1.6 | 0.4 |
| Heart (Fetal) | 0.2 | 0.0 | Renal ca. A498 | 1.1 | 0.0 |
| Pancreas | 4.5 | 0.1 | Renal ca. RXF 393 | 0.1 | 0.0 |
| Pancreatic ca. CAPAN 2 | 2.3 | 0.4 | Renal ca. ACHN | 3.4 | 0.6 |
| Adrenal Gland | 1.6 | 0.1 | Renal ca. UO-31 | 4.5 | 0.1 |
| Thyroid | 0.9 | 0.0 | Renal ca. TK-10 | 8.0 | 2.2 |
| Salivary gland | 3.8 | 0.7 | Liver | 1.0 | 0.0 |
| Pituitary gland | 1.3 | 0.0 | Liver (fetal) | 1.1 | 0.3 |
| Brain (fetal) | 1.0 | 0.0 | Liver ca. (hepatoblast) HepG2 | 1.3 | 0.0 |
| Brain (whole) | 1.0 | 0.0 | Lung | 6.7 | 5.1 |
| Brain (amygdala) | 0.2 | 0.0 | Lung (fetal) | 1.5 | 0.9 |
| Brain (cerebellum) | 1.4 | 0.0 | Lung ca. (small cell) LX-1 | 6.5 | 1.2 |
| Brain (hippocampus) | 0.4 | 0.0 | Lung ca. (small cell) NCI-H69 | 0.9 | 0.1 |
| Brain (thalamus) | 0.6 | 0.0 | Lung ca. (s.cell var.) SHP-77 | 0.4 | 0.0 |
| Cerebral Cortex | 2.0 | 0.0 | Lung ca. (large cell) NCI-H460 | 41.8 | 36.3 |
| Spinal cord | 2.6 | 0.3 | Lung ca. (non-sm. cell) A549 | 3.3 | 0.8 |
| glio/astro U87-MG | 13.5 | 6.5 | Lung ca. (non-s. cell) NCI-H23 | 1.1 | 0.0 |
| glio/astro U-118-MG | 2.2 | 0.9 | Lung ca. (non-s.cell) HOP-62 | 6.8 | 3.7 |
| astrocytoma SW1783 | 1.6 | 0.9 | Lung ca. (non-s.cl) NCI-H522 | 20.6 | 10.1 |
| neuro*; met SK-N-AS | 4.9 | 0.0 | Lung ca. (squam.) SW 900 | 10.4 | 6.5 |
| astrocytoma SF-539 | 0.5 | 0.0 | Lung ca. (squam.) NCI-H596 | 1.5 | 0.0 |
| astrocytoma SNB-75 | 0.1 | 0.0 | Mammary gland | 5.5 | 0.8 |
| glioma SNB-19 | 4.4 | 1.0 | Breast ca.* (pl.ef) MCF-7 | 0.4 | 0.0 |
| glioma U251 | 0.8 | 0.0 | Breast ca.* (pl.ef) MDA-MB-231 | 2.2 | 0.8 |
| glioma SF-295 | 4.0 | 0.0 | Breast ca.* (pl. cf) T47D | 4.0 | 1.9 |
| Heart | 5.3 | 3.4 | Breast ca. BT-549 | 0.7 | 0.1 |
| Skeletal Muscle | 1.4 | 0.0 | Breast ca. MDA-N | 15.0 | 0.0 |
| Bone marrow | 1.7 | 2.1 | Ovary | 0.2 | 0.0 |
| Thymus | 0.0 | 0.2 | Ovarian ca. OVCAR-3 | 16.3 | 6.9 |
| Spleen | 0.6 | 0.0 | Ovarian ca. OVCAR-4 | 0.5 | 0.0 |
| Lymph node | 0.8 | 0.0 | Ovarian ca. OVCAR-5 | 6.9 | 2.6 |
| Colorectal Tissue | 0.1 | 0.0 | Ovarian ca. OVCAR-8 | 0.2 | 0.0 |
| Stomach | 3.7 | 1.8 | Ovarian ca. IGROV-1 | 12.6 | 8.5 |
| Small intestine | 1.1 | 0.1 | Ovarian ca. (ascites) SK-OV-3 | 3.1 | 0.9 |
| Colon ca. SW480 | 0.3 | 0.0 | Uterus | 0.4 | 0.0 |
| Colon ca.* SW620 (SW480 met) | 1.9 | 0.0 | Placenta | 6.5 | 4.7 |
| Colon ca. HT29 | 2.2 | 0.3 | Prostate | 0.8 | 0.0 |
| Colon ca. HCT-116 | 3.4 | 1.4 | Prostate ca.* (bone met) PC-3 | 100.0 | 100.0 |
| Colon ca. CaCo-2 | 1.2 | 0.2 | Testis | 8.7 | 8.0 |
| Colon ca. Tissue (ODO3866) | 0.3 | 0.0 | Melanoma Hs688(A).T | 0.5 | 0.0 |
| Colon ca. HCC-2998 | 5.8 | 2.0 | Melanoma* (met) Hs688(B).T | 1.4 | 0.7 |
| Gastric ca.* (liver met) NCI-N87 | 11.9 | 2.9 | Melanoma UACC-62 | 1.0 | 0.0 |

TABLE 22F-continued

Panel 1.2

| Tissue Name | Rel. Exp.(%) Ag692, Run 114250175 | Rel. Exp.(%) Ag692, Run 117052376 | Tissue Name | Rel. Exp.(%) Ag692, Run 114250175 | Rel. Exp.(%) Ag692, Run 117052376 |
|---|---|---|---|---|---|
| Bladder | 2.5 | 0.8 | Melanoma M14 | 4.0 | 0.0 |
| Trachea | 1.2 | 0.0 | Melanoma LOX IMVI | 1.5 | 0.3 |
| Kidney | 2.3 | 0.0 | Melanoma* (met) SK-MEL-5 | 5.1 | 0.0 |
| Kidney (fetal) | 2.5 | 0.2 | | | |

TABLE 22G

Panel 2D

| Tissue Name | Rel. Exp.(%) Ag264, Run 144872209 | Rel. Exp.(%) Ag692, Run 145177146 | Tissue Name | Rel. Exp.(%) Ag264, Run 144872209 | Rel. Exp.(%) Ag692, Run 145177146 |
|---|---|---|---|---|---|
| Normal Colon | 3.1 | 3.2 | Kidney Margin 8120608 | 0.0 | 0.0 |
| CC Well to Mod Diff (ODO3866) | 0.0 | 0.3 | Kidney Cancer 8120613 | 0.0 | 0.0 |
| CC Margin (ODO3866) | 0.0 | 1.0 | Kidney Margin 8120614 | 0.0 | 0.0 |
| CC Gr.2 rectosigmoid (ODO3868) | 0.7 | 0.0 | Kidney Cancer 9010320 | 0.0 | 0.0 |
| CC Margin (ODO3868) | 0.0 | 0.6 | Kidney Margin 9010321 | 0.0 | 0.3 |
| CC Mod Diff (ODO3920) | 0.0 | 0.0 | Normal Uterus | 0.0 | 0.0 |
| CC Margin (ODO3920) | 0.0 | 0.3 | Uterus Cancer 064011 | 0.0 | 0.5 |
| CC Gr.2 ascend colon (ODO3921) | 0.0 | 0.7 | Normal Thyroid | 0.2 | 0.0 |
| CC Margin (ODO3921) | 0.0 | 1.3 | Thyroid Cancer 064010 | 0.0 | 0.3 |
| CC from Partial Hepatectomy (ODO4309) Mets | 0.0 | 0.3 | Thyroid Cancer A302152 | 0.3 | 0.0 |
| Liver Margin (ODO4309) | 0.0 | 0.0 | Thyroid Margin A302153 | 0.0 | 0.3 |
| Colon mets to lung (OD04451-01) | 0.3 | 1.0 | Normal Breast | 2.6 | 2.4 |
| Lung Margin (OD04451-02) | 4.5 | 1.3 | Breast Cancer (OD04566) | 0.0 | 0.0 |
| Normal Prostate 6546-1 | 0.0 | 1.4 | Breast Cancer (OD04590-01) | 0.0 | 0.0 |
| Prostate Cancer (OD04410) | 0.5 | 0.9 | Breast Cancer Mets (OD04590-03) | 0.3 | 0.0 |
| Prostate Margin (OD04410) | 0.0 | 0.3 | Breast Cancer Metastasis (OD04655-05) | 0.0 | 0.3 |
| Prostate Cancer (OD04720-01) | 0.4 | 0.3 | Breast Cancer 064006 | 11.9 | 7.4 |
| Prostate Margin (OD04720-02) | 1.7 | 2.7 | Breast Cancer 1024 | 3.1 | 3.1 |
| Normal Lung 061010 | 0.3 | 1.1 | Breast Cancer 9100266 | 0.4 | 0.0 |
| Lung Met to Muscle (ODO4286) | 100.0 | 98.6 | Breast Margin 9100265 | 0.0 | 0.3 |
| Muscle Margin (ODO4286) | 0.0 | 0.9 | Breast Cancer A209073 | 22.7 | 16.2 |
| Lung Malignant Cancer (OD03126) | 0.3 | 0.9 | Breast Margin A2090734 | 2.2 | 1.6 |
| Lung Margin (OD03126) | 0.8 | 2.3 | Normal Liver | 0.0 | 0.7 |
| Lung Cancer (OD04404) | 81.2 | 100.0 | Liver Cancer 064003 | 0.0 | 0.5 |
| Lung Margin (OD04404) | 3.7 | 3.8 | Liver Cancer 1025 | 0.0 | 0.3 |
| Lung Cancer | 5.8 | 3.8 | Liver Cancer | 0.0 | 0.0 |

TABLE 22G-continued

Panel 2D

| Tissue Name | Rel. Exp.(%) Ag264, Run 144872209 | Rel. Exp.(%) Ag692, Run 145177146 | Tissue Name | Rel. Exp.(%) Ag264, Run 144872209 | Rel. Exp.(%) Ag692, Run 145177146 |
|---|---|---|---|---|---|
| (OD04565) | | | 1026 | | |
| Lung Margin (OD04565) | 0.0 | 0.7 | Liver Cancer 6004-T | 0.0 | 0.7 |
| Lung Cancer (OD04237-01) | 0.7 | 1.0 | Liver Tissue 6004-N | 0.0 | 0.1 |
| Lung Margin (OD04237-02) | 4.9 | 8.8 | Liver Cancer 6005-T | 0.0 | 0.2 |
| Ocular Mel Met to Liver (ODO4310) | 0.0 | 0.0 | Liver Tissue 6005-N | 0.0 | 0.0 |
| Liver Margin (ODO4310) | 0.0 | 0.5 | Normal Bladder | 0.7 | 0.0 |
| Melanoma Mets to Lung (OD04321) | 0.0 | 0.0 | Bladder Cancer 1023 | 0.0 | 0.0 |
| Lung Margin (OD04321) | 8.8 | 7.5 | Bladder Cancer A302173 | 50.7 | 48.6 |
| Normal Kidney | 0.0 | 1.0 | Bladder Cancer (OD04718-01) | 7.3 | 7.0 |
| Kidney Ca, Nuclear grade 2 (OD04338) | 1.6 | 1.6 | Bladder Normal Adjacent (OD04718-03) | 0.3 | 0.5 |
| Kidney Margin (OD04338) | 0.0 | 0.6 | Normal Ovary | 0.0 | 0.0 |
| Kidney Ca Nuclear grade 1/2 (OD04339) | 0.0 | 1.8 | Ovarian Cancer 064008 | 3.8 | 5.6 |
| Kidney Margin (OD04339) | 0.2 | 0.6 | Ovarian Cancer (OD04768-07) | 0.0 | 0.0 |
| Kidney Ca, Clear cell type (OD04340) | 0.3 | 1.3 | Ovary Margin (OD04768-08) | 34.2 | 28.1 |
| Kidney Margin (OD04340) | 0.8 | 2.4 | Normal Stomach | 0.0 | 0.0 |
| Kidney Ca, Nuclear grade 3 (OD04348) | 0.0 | 0.0 | Gastric Cancer 9060358 | 0.0 | 0.0 |
| Kidney Margin (OD04348) | 1.4 | 0.8 | Stomach Margin 9060359 | 0.0 | 0.0 |
| Kidney Cancer (OD04622-01) | 0.3 | 0.3 | Gastric Cancer 9060395 | 0.3 | 0.5 |
| Kidney Margin (OD04622-03) | 0.3 | 0.3 | Stomach Margin 9060394 | 0.0 | 0.0 |
| Kidney Cancer (OD04450-01) | 0.0 | 0.0 | Gastric Cancer 9060397 | 0.0 | 0.0 |
| Kidney Margin (OD04450-03) | 0.0 | 0.6 | Stomach Margin 9060396 | 0.0 | 0.0 |
| Kidney Cancer 8120607 | 0.3 | 0.0 | Gastric Cancer 064005 | 0.0 | 0.2 |

TABLE 22H

Panel 4D

| Tissue Name | Rel. Exp. (%) Ag692, Run 164318656 | Tissue Name | Rel. Exp. (%) Ag692, Run 164318656 |
|---|---|---|---|
| Secondary Th1 act | 2.2 | HUVEC IL-1beta | 0.3 |
| Secondary Th2 act | 2.8 | HUVEC IFN gamma | 1.3 |
| Secondary Tr1 act | 8.4 | HUVEC TNF alpha + IFN gamma | 0.0 |
| Secondary Th1 rest | 0.4 | HUVEC TNF alpha + IL4 | 0.0 |
| Secondary Th2 rest | 3.5 | HUVEC IL-11 | 0.5 |
| Secondary Tr1 rest | 0.4 | Lung Microvascular EC none | 1.0 |
| Primary Th1 act | 0.4 | Lung Microvascular EC TNFalpha + IL-1beta | 0.4 |
| Primary Th2 act | 1.2 | Microvascular Dermal EC none | 2.1 |
| Primary Tr1 act | 1.4 | Microvascular Dermal EC TNFalpha + IL-1beta | 0.4 |
| Primary Th1 rest | 1.6 | Bronchial epithelium TNFalpha + IL1beta | 12.3 |
| Primary Th2 rest | 2.5 | Small airway epithelium none | 15.6 |
| Primary Tr1 rest | 2.4 | Small airway epithelium TNFalpha + IL-1beta | 100.0 |

TABLE 22H-continued

Panel 4D

| Tissue Name | Rel. Exp. (%) Ag692, Run 164318656 | Tissue Name | Rel. Exp. (%) Ag692, Run 164318656 |
|---|---|---|---|
| CD45RA CD4 lymphocyte act | 1.4 | Coronery artery SMC rest | 3.6 |
| CD45RO CD4 lymphocyte act | 1.8 | Coronery artery SMC TNFalpha + IL-1beta | 0.6 |
| CD8 lymphocyte act | 0.5 | Astrocytes rest | 1.0 |
| Secondary CD8 lymphocyte rest | 1.5 | Astrocytes TNFalpha + IL-1beta | 1.1 |
| Secondary CD8 lymphocyte act | 0.0 | KU-812 (Basophil) rest | 19.1 |
| CD4 lymphocyte none | 2.7 | KU-812 (Basophil) PMA/ionomycin | 48.3 |
| 2ry Th1/Th2/Tr1_anti-CD95 CH11 | 4.2 | CCD1106 (Keratinocytes) none | 14.6 |
| LAK cells rest | 0.0 | CCD1106 (Keratinocytes) TNFalpha + IL-1beta | 14.3 |
| LAK cells IL-2 | 1.2 | Liver cirrhosis | 3.2 |
| LAK cells IL-2 + IL-12 | 1.8 | Lupus kidney | 0.3 |
| LAK cells IL-2 + IFN gamma | 2.5 | NCI-H292 none | 8.5 |
| LAK cells IL-2 + IL-18 | 1.6 | NCI-H292 IL-4 | 9.3 |
| LAK cells PMA/ionomycin | 3.0 | NCI-H292 IL-9 | 13.2 |
| NK Cells IL-2 rest | 0.0 | NCI-H292 IL-13 | 4.5 |
| Two Way MLR 3 day | 2.4 | NCI-H292 IFN gamma | 9.7 |
| Two Way MLR 5 day | 0.8 | HPAEC none | 0.4 |
| Two Way MLR 7 day | 0.0 | HPAEC TNF alpha + IL-1 beta | 1.9 |
| PBMC rest | 0.8 | Lung fibroblast none | 0.9 |
| PBMC PWM | 4.6 | Lung fibroblast TNF alpha + IL-1 beta | 0.0 |
| PBMC PHA-L | 0.0 | Lung fibroblast IL-4 | 1.0 |
| Ramos (B cell) none | 0.8 | Lung fibroblast IL-9 | 1.0 |
| Ramos (B cell) ionomycin | 0.8 | Lung fibroblast IL-13 | 1.0 |
| B lymphocytes PWM | 0.4 | Lung fibroblast IFN gamma | 1.1 |
| B lymphocytes CD40L and IL-4 | 0.7 | Dermal fibroblast CCD1070 rest | 2.6 |
| EOL-1 dbcAMP | 5.6 | Dermal fibroblast CCD1070 TNF alpha | 2.1 |
| EOL-1 dbcAMP PMA/ionomycin | 6.3 | Dermal fibroblast CCD1070 IL-1 beta | 1.9 |
| Dendritic cells none | 0.0 | Dermal fibroblast IFN gamma | 1.1 |
| Dendritic cells LPS | 0.3 | Dermal fibroblast IL-4 | 0.6 |
| Dendritic cells anti-CD40 | 0.9 | IBD Colitis 2 | 0.6 |
| Monocytes rest | 0.4 | IBD Crohn's | 0.4 |
| Monocytes LPS | 9.0 | Colon | 0.1 |
| Macrophages rest | 1.2 | Lung | 0.7 |
| Macrophages LPS | 0.1 | Thymus | 1.3 |
| HUVEC none | 0.0 | Kidney | 2.7 |
| HUVEC starved | 0.7 | | |

CNS_neurodegeneration_v1.0 Summary: Ag692 Expression of the CG55023-01 gene is low/undetectable in all samples on this panel (CTs>35). (Data not shown.)

Panel 1 Summary: Ag264/Ag264b Results of three experiments with the CG55023-01 gene show reasonable concordance. The expression of this gene is found to be highest in a sample derived from a prostate cancer cell line (CTs=24–26). In addition, there is substantial expression in a lung cancer cell line. Thus, the expression of this gene could be used to distinguish this prostate cell line sample from the other samples in the panel. Moreover, therapeutic modulation of this gene, through the use of small molecule drugs, protein therapeutics or antibodies might be of benefit in the treatment of prostate or lung cancer.

Panel 1.2 Summary: Ag692 The expression of the CG55023-01 gene was assessed in two independent runs in this panel with excellent concordance between the results. The expression of this gene is found to be highest in a sample derived from a prostate cancer cell line (CTs= 23–24). In addition there is substantial expression in a lung cancer cell line. This expression profile is consistent with the expression seen in Panel 1. Thus, the expression of this gene could be used to distinguish this prostate cell line sample from the other samples in the panel. Moreover, therapeutic modulation of this gene, through the use of small molecule drugs, protein therapeutics or antibodies might be of benefit in the treatment of prostate or lung cancer.

This gene also shows moderate expression in all CNS regions examined. TGF alpha has numerous roles in the CNS, including regulation of astrocyte reactivity, neuronal differentiation and survival, and protection of motor neurons. Because of its possible neuroprotective effects, this molecule may be of use in the treatment of multiple sclerosis, ALS, Alzheimer's, Parkinson's, or Huntington's diseases, stroke, or brain or spinal cord trauma.

In addition, this gene is moderately expressed in pancreas, adrenal, thyroid, pituitary, skeletal muscle, and adult and fetal liver. Thus, this gene product may be a monoclonal antibody target for the treatment of metabolic and endocrine disease, including obesity and Types 1 and 2 diabetes.

Among metabolic tissues, this gene has highest expression in heart (CT values=27–29), and is 79% identical to mouse epigen protein. Epigen stimulates epithelial cell proliferation (see Panel 4 ref.), suggesting that a monoclonal antibody to this gene product may also be useful for prevention of cardiomyocyte proliferation in diseases of cardiac hypertrophy.

References:

Boillee S, Cadusseau J, Coulpier M, Grannec G, Junier M P. Transforming growth factor alpha: a promoter of motoneuron survival of potential biological relevance. J Neurosci Sep. 15, 2001;21(18):7079–88

Expression of transforming growth factor alpha (TGFalpha), a member of the epidermal growth factor (EGF) family, is a general response of adult murine motoneurons to genetic and experimental lesions, TGFalpha appearing as an inducer of astrogliosis in these situations. Here we address the possibility that TGFalpha expression is not specific to pathological situations but may participate to the embryonic development of motoneurons. mRNA of TGFalpha and its receptor, the EGF receptor (EGFR), were detected by ribonuclease protection assay in the ventral part of the cervical spinal cord from embryonic day 12 (E12) until adult ages. Reverse transcription-PCR amplification of their transcripts from immunopurified E15 motoneurons, associated with in situ double-immunohistological assays, identified embryonic motoneurons as cellular sources of the TGFalpha-EGFR couple. In vitro, TGFalpha promoted the survival of immunopurified E 15 motoneurons in a dose-dependent manner, with a magnitude similar to BDNF neuroprotective effects at equivalent concentrations. In a transgenic mouse expressing a human TGFalpha transgene under the control of the metallothionein 1 promoter, axotomy of the facial nerve provoked significantly less degeneration in the relevant motor pool of 1-week-old mice than in wild-type animals. No protection was observed in neonates, when the transgene exhibits only weak expression levels in the brainstem. In conclusion, our results point to TGFalpha as a physiologically relevant candidate for a neurotrophic role on developing motoneurons. Its expression by the embryonic motoneurons, which also synthesize its receptor, suggests that this chemokine is endowed with the capability to promote motoneuron survival in an autocrine-paracrine manner.

Xian C J, Zhou X F. Roles of transforming growth factor-alpha and related molecules in the nervous system. Mol Neurobiol 1999 October–December;20(2–3): 157–83

The epidermal growth factor (EGF) family of polypeptides is regulators for tissue development and repair, and is characterized by the fact that their mature forms are proteolytically derived from their integral membrane precursors. This article reviews roles of the prominent members of the EGF family (EGF, transforming growth factor-alpha [TGF-alpha] and heparin-binding EGF [HB-EGF]) and the related neuregulin family in the nerve system. These polypeptides, produced by neurons and glial cells, play an important role in the development of the nervous system, stimulating proliferation, migration, and differentiation of neuronal, glial, and Schwann precursor cells. These peptides are also neurotrophic, enhancing survival and inhibiting apoptosis of post-mitotic neurons, probably acting directly through receptors on neurons, or indirectly via stimulating glial proliferation and glial synthesis of other molecules such as neurotrophic factors. TGF-alpha, EGF, and neuregulins are involved in mediating glial-neuronal and axonal-glial interactions, regulating nerve injury responses, and participating in injury-associated astrocytic gliosis, brain tumors, and other disorders of the nerve system. Although the collective roles of the EGF family (as well as those of the neuregulins) are shown to be essential for the nervous system, redundancy may exist among members of the EGF family.

Junier M P. What role(s) for TGFalpha in the central nervous system? Prog Neurobiol 2000 December;62(5): 443–73

Transforming growth factor alpha (TGFalpha) is a member of the epidermal growth factor (EGF) family with which it shares the same receptor, the EGF receptor (EGFR or erbB1). Identified since 1985 in the central nervous system (CNS), its functions in this organ have started to be determined during the past decade although numerous questions remain unanswered. TGFalpha is widely distributed in the nervous system, both glial and neuronal cells contributing to its synthesis. Although astrocytes appear as its main targets, mediating in part TGFalpha effects on different neuronal populations, results from different studies have raised the possibility for a direct action of this growth factor on neurons. A large array of experimental data have thus pointed to TGFalpha as a multifunctional factor in the CNS. This review is an attempt to present, in a comprehensive manner, the very diverse works performed in vitro and in vivo which have provided evidences for (i) an intervention of TGFalpha in the control of developmental events such as neural progenitors proliferation/cell fate choice, neuronal survival/differentiation, and neuronal control of female puberty onset, (ii) its role as a potent regulator of astroglial metabolism including astrocytic reactivity, (iii) its neuroprotective potential, and (iv) its participation to neuropathological processes as exemplified by astroglial neoplasia. In addition, informations regarding the complex modes of TGFalpha action at the molecular level are provided, and its place within the large EGF family is precised with regard to the potential interactions and substitutions which may take place between TGFalpha and its kindred.

Panel 2D Summary: Ag264/692 The expression of the CG55023-01 gene was assessed in two independent runs on panel 2D using two different probe/primer pairs. The expression of this gene appears to be highest in samples derived from lung cancer tissue (CTs=28–30). In addition, there is substantial expression in samples derived from two breast cancers, bladder cancer and a sample of normal ovarian tissue. Thus, the expression of this gene could be used to distinguish these lung cancer samples from other samples in the panel. Moreover, therapeutic modulation of this gene, through the use of small molecule drugs, antibodies or protein therapeutics may be of benefit to the treatment of lung cancer, breast cancer or bladder cancer.

Panel 4D Summary: Ag692 The CG55023-01, a TGF-alpha-like Epigen protein homolog, is most highly expressed in small airway epithelium activated with TNFalpha+1L-1beta (CT=28.71) and in KU-812 basophil cells activated with phorbol ester and ionomycin (CT=29.76). Epigne has been shown to stimulate the growth of epithelial cells. Therefore, antibodies that block the action of the CG55023-01 gene product may be useful as therapeutics to reduce or eliminate the symptoms in patients with asthma, emphysema, and allergy.

References:

Strachan L, Murison J G, Prestidge R L, Sleeman M A, Watson J D, Kumble K D. Cloning and biological activity of epigen, a novel member of the epidermal growth factor superfamily. J. Biol. Chem. May 25, 2001;276(21): 18265–71.

High throughput sequencing of a mouse keratinocyte library was used to identify an expressed sequence tag with homology to the epidermal growth factor (EGF) family of growth factors. We have named the protein encoded by this expressed sequence tag Epigen, for epithelial mitogen. Epigen encodes a protein of 152 amino acids that contains features characteristic of the EGF superfamily. Two hydrophobic regions, corresponding to a putative signal sequence and transmembrane domain, flank a core of amino acids encompassing six cysteine residues and two putative N-linked glycosylation sites. Epigen shows 24–37% identity to members of the EGF superfamily including EGF, transforming growth factor alpha, and Epiregulin. Northern blotting of several adult mouse tissues indicated that Epigen was present in testis, heart, and liver. Recombinant Epigen was synthesized in *Escherichia coli* and refolded, and its biological activity was compared with that of EGF and transforming growth factor alpha in several assays. In epithelial cells, Epigen stimulated the phosphorylation of c-erbB-1 and mitogen-activated protein kinases and also activated a reporter gene containing enhancer sequences present in the c-fos promoter. Epigen also stimulated the proliferation of HaCaT cells, and this proliferation was blocked by an antibody to the extracellular domain of the receptor tyrosine kinase c-erbB-1. Thus, Epigen is the newest member of the EGF superfamily and, with its ability to promote the growth of epithelial cells, may constitute a novel molecular target for wound-healing therapy.

PMID: 11278323

SEC1 (CG55688-01)

Expression of gene CG55688-01 was assessed using the primer-probe set Ag1148, described in Table 23A. Results of the RTQ-PCR runs are shown in Tables 23B, 23C, 23D, 23E, 23F, 23G and 23H.

TABLE 23A

Probe Name Ag1148

| Primers | Sequences | | Length | Start Position |
|---|---|---|---|---|
| Forward | 5'-gtgtctgtgagaggcagctatc-3' | (SEQ ID NO:153) | 22 | 1683 |
| Probe | TET-5'-tgcactctaaactgcaaacagaaatcagg-3'-TAMRA | (SEQ ID NO:154) | 29 | 1705 |
| Reverse | 5'-ccccaaaagctacattttgata-3' | (SEQ ID NO:155) | 22 | 1758 |

TABLE 23B

General_screening_panel_v1.5

| Tissue Name | Rel. Exp. (%) Ag1148, Run 230220165 | Tissue Name | Rel. Exp. (%) Ag1148, Run 230220165 |
|---|---|---|---|
| Adipose | 2.8 | Renal ca. TK-10 | 23.7 |
| Melanoma* Hs688(A).T | 100.0 | Bladder | 1.8 |
| Melanoma* Hs688(B).T | 57.0 | Gastric ca. (liver met.) NCI-N87 | 2.0 |
| Melanoma* M14 | 0.0 | Gastric ca. KATO III | 0.5 |
| Melanoma*LOXIMVI | 10.0 | Colon ca. SW-948 | 0.0 |
| Melanoma*SK-MEL-5 | 0.0 | Colon ca. SW480 | 3.4 |
| Squamous cell carcinoma SCC-4 | 3.1 | Colon ca.* (SW480 met) SW620 | 0.0 |
| Testis Pool | 1.6 | Colon ca. HT29 | 0.0 |
| Prostate ca.* (bone met) PC-3 | 1.6 | Colon ca. HCT-116 | 0.6 |
| Prostate Pool | 0.6 | Colon ca. CaCo-2 | 0.5 |
| Placenta | 1.0 | Colon cancer tissue | 8.4 |
| Uterus Pool | 0.0 | Colon ca. SW1116 | 0.0 |
| Ovarian ca. OVCAR-3 | 2.9 | Colon ca. Colo-205 | 0.0 |
| Ovarian ca. SK-OV-3 | 6.7 | Colon ca. SW-48 | 0.0 |
| Ovarian ca. OVCAR-4 | 46.3 | Colon Pool | 14.9 |
| Ovarian ca. OVCAR-5 | 3.6 | Small Intestine Pool | 2.6 |
| Ovarian ca. IGROV-1 | 5.7 | Stomach Pool | 4.7 |
| Ovarian ca. OVCAR-8 | 6.2 | Bone Marrow Pool | 1.1 |
| Ovary | 6.3 | Fetal Heart | 1.9 |
| Breast ca. MCF-7 | 0.0 | Heart Pool | 3.6 |
| Breast ca. MDA-MB-231 | 21.2 | Lymph Node Pool | 5.8 |
| Breast ca. BT 549 | 32.8 | Fetal Skeletal Muscle | 2.0 |
| Breast ca. T47D | 1.6 | Skeletal Muscle Pool | 3.0 |
| Breast ca. MDA-N | 0.0 | Spleen Pool | 7.4 |
| Breast Pool | 12.9 | Thymus Pool | 8.7 |
| Trachea | 4.6 | CNS cancer (glio/astro) U87-MG | 0.0 |
| Lung | 6.5 | CNS cancer (glio/astro) U-118-MG | 5.8 |
| Fetal Lung | 23.7 | CNS cancer (neuro;met) SK-N-AS | 0.0 |
| Lung ca. NCI-N417 | 0.0 | CNS cancer (astro) SF-539 | 6.4 |
| Lung ca. LX-1 | 0.0 | CNS cancer (astro) SNB-75 | 37.6 |
| Lung ca. NCI-H146 | 0.0 | CNS cancer (glio) SNB-19 | 0.0 |
| Lung ca. SHP-77 | 0.0 | CNS cancer (glio) SF-295 | 10.4 |
| Lung ca. A549 | 0.7 | Brain (Amygdala) Pool | 0.0 |
| Lung ca. NCI-H526 | 0.0 | Brain (cerebellum) | 0.0 |
| Lung ca. NCI-H23 | 1.6 | Brain (fetal) | 0.0 |
| Lung ca. NCI-H460 | 0.0 | Brain (Hippocampus) Pool | 0.0 |
| Lung ca. HOP-62 | 0.0 | Cerebral Cortex Pool | 0.0 |

TABLE 23B-continued

General_screening_panel_v1.5

| Tissue Name | Rel. Exp. (%) Ag1148, Run 230220165 | Tissue Name | Rel. Exp. (%) Ag1148, Run 230220165 |
|---|---|---|---|
| Lung ca. NCI-H522 | 8.5 | Brain (Substantia nigra) Pool | 0.0 |
| Liver | 0.0 | Brain (Thalamus) Pool | 0.0 |
| Fetal Liver | 0.0 | Brain (whole) | 0.0 |
| Liver ca. HepG2 | 0.0 | Spinal Cord Pool | 0.0 |
| Kidney Pool | 49.3 | Adrenal Gland | 1.0 |
| Fetal Kidney | 1.5 | Pituitary gland Pool | 0.5 |
| Renal ca. 786-0 | 15.0 | Salivary Gland | 0.0 |
| Renal ca. A498 | 2.5 | Thyroid (female) | 3.5 |
| Renal ca. ACHN | 14.4 | Pancreatic ca. CAPAN2 | 0.6 |
| Renal ca. UO-31 | 17.7 | Pancreas Pool | 18.7 |

TABLE 23C

Panel 1.2

| Tissue Name | Rel. Exp.(%) Ag1148, Run 126901413 | Rel. Exp.(%) Ag1148, Run 127126116 | Tissue Name | Rel. Exp.(%) Ag1148, Run 126901413 | Rel. Exp.(%) Ag1148, Run 127126116 |
|---|---|---|---|---|---|
| Endothelial cells | 11.0 | 19.3 | Renal ca. 786-0 | 16.4 | 4.9 |
| Heart (Fetal) | 49.7 | 100.0 | Renal ca. A498 | 0.0 | 0.0 |
| Pancreas | 0.9 | 0.0 | Renal ca. RXF 393 | 30.6 | 33.9 |
| Pancreatic ca. CAPAN 2 | 0.0 | 0.0 | Renal ca. ACHN | 27.2 | 21.9 |
| Adrenal Gland | 76.8 | 63.3 | Renal ca. UO-31 | 17.4 | 0.1 |
| Thyroid | 6.1 | 1.0 | Renal ca. TK-10 | 22.5 | 3.9 |
| Salivary gland | 19.3 | 3.1 | Liver | 39.2 | 58.6 |
| Pituitary gland | 3.4 | 0.1 | Liver (fetal) | 12.9 | 16.4 |
| Brain (fetal) | 0.8 | 1.0 | Liver ca. (hepatoblast) HepG2 | 0.5 | 0.0 |
| Brain (whole) | 0.2 | 0.0 | Lung | 59.9 | 92.0 |
| Brain (amygdala) | 0.1 | 0.0 | Lung (fetal) | 9.5 | 7.2 |
| Brain (cerebellum) | 0.0 | 0.0 | Lung ca. (small cell) LX-1 | 0.0 | 0.0 |
| Brain (hippocampus) | 0.6 | 0.5 | Lung ca. (small cell) NCI-H69 | 0.0 | 0.0 |
| Brain (thalamus) | 0.0 | 0.0 | Lung ca. (s.cell var.) SHP-77 | 0.0 | 0.0 |
| Cerebral Cortex | 0.1 | 0.0 | Lung ca. (large cell) NCI-H460 | 3.7 | 3.0 |
| Spinal cord | 1.0 | 0.0 | Lung ca. (non-sm. cell) A549 | 0.0 | 0.0 |
| glio/astro U87-MG | 0.2 | 0.0 | Lung ca. (non-s.cell) NCI-H23 | 0.9 | 0.0 |
| glio/astro U-118-MG | 10.7 | 8.2 | Lung ca. (non-s.cell) HOP-62 | 1.5 | 0.0 |
| astrocytoma SW1783 | 17.1 | 17.7 | Lung ca. (non-s.cl) NCI-H522 | 53.2 | 24.0 |
| neuro*; met SK-N-AS | 0.0 | 0.0 | Lung ca. (squam.) SW 900 | 0.2 | 0.0 |
| astrocytoma SF-539 | 8.8 | 4.2 | Lung ca. (squam.) NCI-H596 | 0.0 | 0.0 |
| astrocytoma SNB-75 | 2.0 | 0.5 | Mammary gland | 45.1 | 19.3 |
| glioma SNB-19 | 9.2 | 5.3 | Breast ca.* (pl.ef) MCF-7 | 0.0 | 0.0 |
| glioma U251 | 11.5 | 1.6 | Breast ca.* (pl.ef) MDA-MB-231 | 14.9 | 2.2 |
| glioma SF-295 | 4.4 | 0.2 | Breast ca.* (pl. ef) T47D | 0.0 | 0.0 |
| Heart | 100.0 | 87.7 | Breast ca. BT-549 | 16.5 | 13.3 |
| Skeletal Muscle | 10.7 | 5.2 | Breast ca. MDA-N | 0.0 | 0.0 |
| Bone marrow | 1.1 | 1.6 | Ovary | 22.4 | 28.1 |
| Thymus | 0.3 | 0.4 | Ovarian ca. OVCAR-3 | 0.0 | 0.1 |

TABLE 23C-continued

Panel 1.2

| Tissue Name | Rel. Exp.(%) Ag1148, Run 126901413 | Rel. Exp.(%) Ag1148, Run 127126116 | Tissue Name | Rel. Exp.(%) Ag1148, Run 126901413 | Rel. Exp.(%) Ag1148, Run 127126116 |
|---|---|---|---|---|---|
| Spleen | 3.3 | 1.0 | Ovarian ca. OVCAR-4 | 56.3 | 57.8 |
| Lymph node | 30.8 | 48.0 | Ovarian ca. OVCAR-5 | 0.0 | 0.0 |
| Colorectal Tissue | 0.2 | 0.0 | Ovarian ca. OVCAR-8 | 25.0 | 2.7 |
| Stomach | 0.5 | 0.0 | Ovarian ca. IGROV-1 | 3.2 | 0.0 |
| Small intestine | 4.0 | 1.4 | Ovarian ca. (ascites) SK-OV-3 | 0.2 | 0.0 |
| Colon ca. SW480 | 0.0 | 0.0 | Uterus | 12.3 | 15.8 |
| Colon ca.* SW620 (SW480 met) | 0.0 | 0.0 | Placenta | 32.1 | 28.1 |
| Colon ca. HT29 | 0.0 | 0.0 | Prostate | 8.8 | 0.8 |
| Colon ca. HCT-116 | 0.0 | 0.0 | Prostate ca.* (bone met) PC-3 | 0.0 | 0.0 |
| Colon ca. CaCo-2 | 0.0 | 0.0 | Testis | 0.9 | 0.0 |
| Colon ca. Tissue (ODO3866) | 4.5 | 3.8 | Melanoma Hs688(A).T | 73.2 | 45.7 |
| Colon ca. HCC-2998 | 0.0 | 0.0 | Melanoma* (met) Hs688(B).T | 35.6 | 13.1 |
| Gastric ca.* (liver met) NCI-N87 | 0.1 | 0.0 | Melanoma UACC-62 | 0.0 | 0.0 |
| Bladder | 15.3 | 23.5 | Melanoma M14 | 0.0 | 0.0 |
| Trachea | 8.0 | 10.9 | Melanoma LOX IMVI | 17.4 | 2.9 |
| Kidney | 21.2 | 3.2 | Melanoma* (met) SK-MEL-5 | 0.0 | 0.0 |
| Kidney (fetal) | 29.7 | 29.9 | | | |

TABLE 23D

Panel 1.3D

| Tissue Name | Rel. Exp. (%) Ag1148, Run 151759893 | Tissue Name | Rel. Exp. (%) Ag1148, Run 151759893 |
|---|---|---|---|
| Liver adenocarcinoma | 4.5 | Kidney (fetal) | 9.9 |
| Pancreas | 1.8 | Renal ca. 786-0 | 13.0 |
| Pancreatic ca. CAPAN 2 | 0.6 | Renal ca. A498 | 11.1 |
| Adrenal gland | 6.3 | Renal ca. RXF 393 | 20.2 |
| Thyroid | 11.2 | Renal ca. ACHN | 17.2 |
| Salivary gland | 1.5 | Renal ca. UO-31 | 26.1 |
| Pituitary gland | 1.3 | Renal ca. TK-10 | 10.2 |
| Brain (fetal) | 0.8 | Liver | 1.0 |
| Brain (whole) | 1.4 | Liver (fetal) | 8.0 |
| Brain (amygdala) | 0.8 | Liver ca. (hepatoblast) HepG2 | 0.9 |
| Brain (cerebellum) | 0.1 | Lung | 45.4 |
| Brain (hippocampus) | 5.9 | Lung (fetal) | 34.9 |
| Brain (substantia nigra) | 1.7 | Lung ca. (small cell) LX-1 | 0.1 |
| Brain (thalamus) | 1.2 | Lung ca. (small cell) NCI-H69 | 0.0 |
| Cerebral Cortex | 1.5 | Lung ca. (s.cell var.) SHP-77 | 0.0 |
| Spinal cord | 2.0 | Lung ca. (large cell) NCI-H460 | 0.2 |
| glio/astro U87-MG | 0.7 | Lung ca. (non-sm.cell) A549 | 0.2 |
| glio/astro U-118-MG | 19.6 | Lung ca. (non-s.cell) NCI-H23 | 2.8 |
| astrocytoma SW1783 | 21.8 | Lung ca. (non-s.cell) HOP-62 | 1.9 |
| neuro*; met SK-N-AS | 0.8 | Lung ca. (non-s.cl) NCI-H522 | 12.2 |
| astrocytoma SF-539 | 16.3 | Lung ca. (squam.) SW 900 | 2.7 |
| astrocytoma SNB-75 | 11.3 | Lung ca. (squam.) NCI-H596 | 0.0 |
| glioma SNB-19 | 8.4 | Mammary gland | 45.4 |

TABLE 23D-continued

Panel 1.3D

| Tissue Name | Rel. Exp. (%) Ag1148, Run 151759893 | Tissue Name | Rel. Exp. (%) Ag1148, Run 151759893 |
|---|---|---|---|
| glioma U251 | 10.2 | Breast ca.* (pl.ef) MCF-7 | 0.1 |
| glioma SF-295 | 5.6 | Breast ca.* (pl.ef) MDA-MB-231 | 16.7 |
| Heart (fetal) | 28.9 | Breast ca.* (pl.ef) T47D | 1.3 |
| Heart | 9.5 | Breast ca. BT-549 | 11.1 |
| Skeletal muscle (fetal) | 14.1 | Breast ca. MDA-N | 0.3 |
| Skeletal muscle | 3.3 | Ovary | 16.3 |
| Bone marrow | 1.7 | Ovarian ca. OVCAR-3 | 1.6 |
| Thymus | 1.2 | Ovarian ca. OVCAR-4 | 12.7 |
| Spleen | 12.6 | Ovarian ca. OVCAR-5 | 1.9 |
| Lymph node | 21.3 | Ovarian ca. OVCAR-8 | 12.6 |
| Colorectal | 8.6 | Ovarian ca. IGROV-1 | 1.8 |
| Stomach | 5.2 | Ovarian ca.* (ascites) SK-OV-3 | 3.5 |
| Small intestine | 9.9 | Uterus | 11.0 |
| Colon ca. SW480 | 2.6 | Placenta | 9.0 |
| Colon ca.* SW620 (SW480 met) | 0.1 | Prostate | 5.7 |
| Colon ca. HT29 | 0.1 | Prostate ca.* (bone met)PC-3 | 1.9 |
| Colon ca. HCT-116 | 1.0 | Testis | 3.8 |
| Colon ca. CaCo-2 | 0.7 | Melanoma Hs688(A).T | 100.0 |
| Colon ca. tissue(ODO3866) | 9.8 | Melanoma* (met) Hs688(B).T | 88.3 |
| Colon ca. HCC-2998 | 0.6 | Melanoma UACC-62 | 0.2 |
| Gastric ca.* (liver met) NCI-N87 | 3.0 | Melanoma M14 | 0.1 |
| Bladder | 2.5 | Melanoma LOX IMVI | 3.1 |
| Trachea | 17.9 | Melanoma* (met) SK-MEL-5 | 0.1 |
| Kidney | 1.8 | Adipose | 45.4 |

TABLE 23E

Panel 2D

| Tissue Name | Rel. Exp.(%) Ag1148, Run 145375638 | Rel. Exp.(%) Ag1148, Run 147104767 | Tissue Name | Rel. Exp.(%) Ag1148, Run 145375638 | Rel. Exp.(%) Ag1148, Run 147104767 |
|---|---|---|---|---|---|
| Normal Colon | 5.0 | 15.7 | Kidney Margin 8120608 | 6.3 | 6.6 |
| CC Well to Mod Diff (ODO3866) | 3.9 | 14.6 | Kidney Cancer 8120613 | 0.6 | 0.7 |
| CC Margin (ODO3866) | 9.0 | 23.7 | Kidney Margin 8120614 | 1.1 | 4.0 |
| CC Gr.2 rectosigmoid (ODO3868) | 0.7 | 1.7 | Kidney Cancer 9010320 | 4.3 | 14.6 |
| CC Margin (ODO3868) | 3.3 | 5.6 | Kidney Margin 9010321 | 4.7 | 6.7 |
| CC Mod Diff (ODO3920) | 0.4 | 1.0 | Normal Uterus | 33.2 | 25.5 |
| CC Margin (ODO3920) | 3.0 | 5.9 | Uterus Cancer 064011 | 72.7 | 44.1 |
| CC Gr.2 ascend colon (ODO3921) | 67.4 | 14.3 | Normal Thyroid | 8.6 | 11.2 |
| CC Margin (ODO3921) | 3.5 | 11.3 | Thyroid Cancer 064010 | 8.4 | 5.0 |
| CC from Partial Hepatectomy (ODO4309) Mets | 2.3 | 6.0 | Thyroid Cancer A302152 | 5.5 | 4.9 |
| Liver Margin (ODO4309) | 0.9 | 3.5 | Thyroid Margin A302153 | 40.1 | 35.4 |
| Colon mets to lung (OD04451-01) | 4.2 | 3.9 | Normal Breast | 25.3 | 23.2 |
| Lung Margin (OD04451-02) | 1.7 | 3.5 | Breast Cancer (OD04566) | 4.2 | 2.5 |
| Normal Prostate 6546-1 | 4.9 | 5.1 | Breast Cancer (OD04590-01) | 1.5 | 3.8 |

TABLE 23E-continued

Panel 2D

| Tissue Name | Rel. Exp.(%) Ag1148, Run 145375638 | Rel. Exp.(%) Ag1148, Run 147104767 | Tissue Name | Rel. Exp.(%) Ag1148, Run 145375638 | Rel. Exp.(%) Ag1148, Run 147104767 |
|---|---|---|---|---|---|
| Prostate Cancer (OD04410) | 21.9 | 29.9 | Breast Cancer Mets (OD04590-03) | 16.4 | 9.7 |
| Prostate Margin (OD04410) | 39.2 | 30.8 | Breast Cancer Metastasis (OD04655-05) | 3.1 | 2.3 |
| Prostate Cancer (OD04720-01) | 9.7 | 8.6 | Breast Cancer 064006 | 5.0 | 5.3 |
| Prostate Margin (OD04720-02) | 49.3 | 44.4 | Breast Cancer 1024 | 1.6 | 5.1 |
| Normal Lung 061010 | 19.3 | 21.5 | Breast Cancer 9100266 | 5.2 | 3.9 |
| Lung Met to Muscle (ODO4286) | 2.8 | 2.6 | Breast Margin 9100265 | 6.7 | 5.1 |
| Muscle Margin (ODO4286) | 12.3 | 8.0 | Breast Cancer A209073 | 8.8 | 5.6 |
| Lung Malignant Cancer (OD03126) | 10.0 | 1.0 | Breast Margin A2090734 | 1.0 | 1.8 |
| Lung Margin (OD03126) | 17.6 | 32.3 | Normal Liver | 0.6 | 0.6 |
| Lung Cancer (OD04404) | 4.7 | 11.7 | Liver Cancer 064003 | 0.2 | 0.8 |
| Lung Margin (OD04404) | 3.0 | 7.2 | Liver Cancer 1025 | 1.6 | 4.7 |
| Lung Cancer (OD04565) | 4.0 | 2.8 | Liver Cancer 1026 | 1.4 | 3.6 |
| Lung Margin (OD04565) | 11.8 | 4.7 | Liver Cancer 6004-T | 2.2 | 4.1 |
| Lung Cancer (OD04237-01) | 5.1 | 5.1 | Liver Tissue 6004-N | 0.3 | 2.1 |
| Lung Margin (OD04237-02) | 7.2 | 21.6 | Liver Cancer 6005-T | 2.0 | 4.4 |
| Ocular Mel Met to Liver (ODO4310) | 1.2 | 0.7 | Liver Tissue 6005-N | 0.8 | 1.8 |
| Liver Margin (ODO4310) | 6.9 | 5.2 | Normal Bladder | 6.2 | 8.9 |
| Melanoma Mets to Lung (OD04321) | 3.0 | 2.9 | Bladder Cancer 1023 | 3.8 | 4.6 |
| Lung Margin (OD04321) | 33.2 | 37.4 | Bladder Cancer A302173 | 0.8 | 2.4 |
| Normal Kidney | 11.2 | 21.5 | Bladder Cancer (OD04718-01) | 6.2 | 9.7 |
| Kidney Ca, Nuclear grade 2 (OD04338) | 11.8 | 17.2 | Bladder Normal Adjacent (OD04718-03) | 50.0 | 100.0 |
| Kidney Margin (OD04338) | 17.8 | 34.6 | Normal Ovary | 1.6 | 7.5 |
| Kidney Ca Nuclear grade 1/2 (OD04339) | 2.6 | 5.2 | Ovarian Cancer 064008 | 26.1 | 69.3 |
| Kidney Margin (OD04339) | 15.8 | 15.4 | Ovarian Cancer (OD04768-07) | 7.7 | 18.0 |
| Kidney Ca, Clear cell type (OD04340) | 100.0 | 59.0 | Ovary Margin (OD04768-08) | 75.8 | 62.0 |
| Kidney Margin (OD04340) | 36.1 | 57.0 | Normal Stomach | 2.6 | 8.0 |
| Kidney Ca, Nuclear grade 3 (OD04348) | 2.6 | 2.0 | Gastric Cancer 9060358 | 0.5 | 1.5 |
| Kidney Margin (OD04348) | 25.3 | 14.5 | Stomach Margin 9060359 | 2.5 | 7.0 |
| Kidney Cancer (OD04622-01) | 32.8 | 15.5 | Gastric Cancer 9060395 | 1.5 | 6.0 |
| Kidney Margin (OD04622-03) | 6.2 | 3.7 | Stomach Margin 9060394 | 2.1 | 8.7 |
| Kidney Cancer (OD04450-01) | 12.5 | 9.1 | Gastric Cancer 9060397 | 4.4 | 16.7 |
| Kidney Margin (OD04450-03) | 19.5 | 14.8 | Stomach Margin 9060396 | 0.6 | 1.9 |
| Kidney Cancer 8120607 | 3.8 | 2.9 | Gastric Cancer 064005 | 2.0 | 7.0 |

TABLE 23F

Panel 3D

| Tissue Name | Rel. Exp. (%) Ag1148, Run 163476715 | Tissue Name | Rel. Exp. (%) Ag1148, Run 163476715 |
|---|---|---|---|
| Daoy- Medulloblastoma | 15.3 | Ca Ski- Cervical epidermoid carcinoma (metastasis) | 52.9 |
| TE671- Medulloblastoma | 0.0 | ES-2- Ovarian clear cell carcinoma | 26.8 |
| D283 Med- Medulloblastoma | 1.5 | Ramos- Stimulated with PMA/ionomycin 6 h | 0.0 |
| PFSK-1- Primitive Neuroectodermal | 3.4 | Ramos- Stimulated with PMA/ionomycin 14 h | 0.1 |
| XF-498- CNS | 22.1 | MEG-01- Chronic myclogenous leukemia (megokaryoblast) | 0.9 |
| SNB-78- Glioma | 25.2 | Raji- Burkitt's lymphoma | 0.1 |
| SF-268- Glioblastoma | 60.3 | Daudi- Burkitt's lymphoma | 0.2 |
| T98G- Glioblastoma | 19.2 | U266- B-cell plasmacytoma | 0.0 |
| SK-N-SH- Neuroblastoma (metastasis) | 13.0 | CA46- Burkitt's lymphoma | 0.0 |
| SF-295- Glioblastoma | 3.5 | RL- non-Hodgkin's B-cell lymphoma | 0.0 |
| Cerebellum | 0.3 | JM1- pre-B-cell lymphoma | 0.0 |
| Cerebellum | 0.1 | Jurkat- T cell leukemia | 0.0 |
| NCI-H292- Mucoepidermoid lung carcinoma | 100.0 | TF-1- Erythroleukemia | 0.3 |
| DMS-114- Small cell lung cancer | 2.7 | HUT 78- T-cell lymphoma | 0.0 |
| DMS-79- Small cell lung cancer | 0.2 | U937- Histiocytic lymphoma | 0.0 |
| NCI-H146- Small cell lung cancer | 0.0 | KU-812- Myelogenous leukemia | 0.2 |
| NCI-H526- Small cell lung cancer | 0.0 | 769-P- Clear cell renal carcinoma | 17.7 |
| NCI-N417- Small cell lung cancer | 0.0 | Caki-2- Clear cell renal carcinoma | 1.7 |
| NCI-H82- Small cell lung cancer | 0.1 | SW 839- Clear cell renal carcinoma | 71.7 |
| NCI-H157- Squamous cell lung cancer (metastasis) | 42.0 | G401- Wilms' tumor | 3.0 |
| NCI-H1155- Large cell lung cancer | 0.5 | Hs766T- Pancreatic carcinoma (LN metastasis) | 15.4 |
| NCI-H1299- Large cell lung cancer | 23.5 | CAPAN-1- Pancreatic adenocarcinoma (liver metastasis) | 6.9 |
| NCI-H727- Lung carcinoid | 0.3 | SU86.86- Pancreatic carcinoma (liver metastasis) | 14.6 |
| NCI-UMC-11- Lung carcinoid | 0.1 | BxPC-3- Pancreatic adenocarcinoma | 3.6 |
| LX-1- Small cell lung cancer | 0.0 | HPAC- Pancreatic adenocarcinoma | 4.0 |
| Colo-205- Colon cancer | 0.0 | MIA PaCa-2- Pancreatic carcinoma | 3.4 |
| KM12- Colon cancer | 0.9 | CFPAC-1- Pancreatic ductal adenocarcinoma | 28.3 |
| KM20L2- Colon cancer | 0.2 | PANC-1- Pancreatic epithelioid ductal carcinoma | 16.2 |
| NCI-H716- Colon cancer | 1.0 | T24- Bladder carcinoma (transitional cell) | 12.1 |
| SW-48- Colon adenocarcinoma | 0.0 | 5637- Bladder carcinoma | 3.1 |
| SW1116- Colon adenocarcinoma | 0.5 | HT-1197- Bladder carcinoma | 14.6 |
| LS 174T- Colon adenocarcinoma | 0.8 | UM-UC-3- Bladder carcinoma (transitional cell) | 4.6 |
| SW-948- Colon adenocarcinoma | 0.0 | A204- Rhabdomyosarcoma | 0.7 |
| SW-480- Colon adenocarcinoma | 0.0 | HT-1080- Fibrosarcoma | 15.8 |
| NCI-SNU-5- Gastric carcinoma | 3.5 | MG-63- Osteosarcoma | 53.2 |
| KATO III- Gastric carcinoma | 0.7 | SK-LMS-1- Leiomyosarcoma (vulva) | 55.5 |
| NCI-SNU-16- Gastric carcinoma | 6.3 | SJRH30- Rhabdomyosarcoma (met to bone marrow) | 1.7 |
| NCI-SNU-1- Gastric carcinoma | 0.4 | A431- Epidermoid carcinoma | 1.6 |
| RF-1- Gastric adenocarcinoma | 0.0 | WM266-4- Melanoma | 0.5 |
| RF-48- Gastric adenocarcinoma | 0.0 | DU 145- Prostate carcinoma (brain metastasis) | 1.8 |

TABLE 23F-continued

Panel 3D

| Tissue Name | Rel. Exp. (%) Ag1148, Run 163476715 | Tissue Name | Rel. Exp. (%) Ag1148, Run 163476715 |
|---|---|---|---|
| MKN-45- Gastric carcinoma | 1.6 | MDA-MB-468- Breast adenocarcinoma | 1.8 |
| NCI-N87-Gastric carcinoma | 1.0 | SCC-4- Squamous cell carcinoma of tongue | 1.3 |
| OVCAR-5- Ovarian carcinoma | 0.9 | SCC-9- Squamous cell carcinoma of tongue | 1.0 |
| RL95-2- Uterine carcinoma | 1.4 | SCC-15- Squamous cell carcinoma of tongue | 1.3 |
| HelaS3- Cervical adenocarcinoma | 1.6 | CAL 27- Squamous cell carcinoma of tongue | 20.7 |

TABLE 23G

Panel 4D

| Tissue Name | Rel. Exp. (%) Ag1148, Run 145386435 | Tissue Name | Rel. Exp. (%) Ag1148, Run 145386435 |
|---|---|---|---|
| Secondary Th1 act | 0.0 | HUVEC IL-1beta | 17.7 |
| Secondary Th2 act | 0.0 | HUVEC IFN gamma | 40.3 |
| Secondary Tr1 act | 0.0 | HUVEC TNF alpha + IFN gamma | 30.1 |
| Secondary Th1 rest | 0.0 | HUVEC TNF alpha + IL4 | 42.6 |
| Secondary Th2 rest | 0.0 | HUVEC IL-11 | 19.8 |
| Secondary Tr1 rest | 0.0 | Lung Microvascular EC none | 63.7 |
| Primary Th1 act | 0.1 | Lung Microvascular EC TNFalpha + IL-1beta | 46.7 |
| Primary Th2 act | 0.3 | Microvascular Dermal EC none | 93.3 |
| Primary Tr1 act | 0.5 | Microvascular Dermal EC TNFalpha + IL-1beta | 71.7 |
| Primary Th1 rest | 0.5 | Bronchial epithelium TNFalpha + IL1beta | 16.7 |
| Primary Th2 rest | 0.4 | Small airway epithelium none | 5.3 |
| Primary Tr1 rest | 0.1 | Small airway epithelium TNFalpha + IL-1beta | 29.5 |
| CD45RA CD4 lymphocyte act | 39.0 | Coronery artery SMC rest | 46.0 |
| CD45RO CD4 lymphocyte act | 0.1 | Coronery artery SMC TNFalpha + IL-1beta | 48.0 |
| CD8 lymphocyte act | 0.1 | Astrocytes rest | 13.0 |
| Secondary CD8 lymphocyte rest | 0.0 | Astrocytes TNFalpha + IL-1 beta | 28.7 |
| Secondary CD8 lymphocyte act | 0.0 | KU-812 (Basophil) rest | 0.2 |
| CD4 lymphocyte none | 0.0 | KU-812 (Basophil) PMA/ionomycin | 0.7 |
| 2ry Th1/Th2/Tr1_anti-CD95 CH11 | 0.3 | CCD1106 (Keratinocytes) none | 4.5 |
| LAK cells rest | 0.0 | CCD1106 (Keratinocytes) TNFalpha + IL-1beta | 12.7 |
| LAK cells IL-2 | 0.1 | Liver cirrhosis | 7.1 |
| LAK cells IL-2 + IL-12 | 0.3 | Lupus kidney | 2.5 |
| LAK cells IL-2 + IFN gamma | 0.4 | NCI-H292 none | 23.7 |
| LAK cells IL-2 + IL-18 | 0.0 | NCI-H292 IL-4 | 12.3 |
| LAK cells PMA/ionomycin | 0.3 | NCI-H292 IL-9 | 11.7 |
| NK Cells IL-2 rest | 0.0 | NCI-H292 IL-13 | 12.2 |
| Two Way MLR 3 day | 0.1 | NCI-H292 IFN gamma | 13.5 |
| Two Way MLR 5 day | 0.2 | HPAEC none | 42.3 |
| Two Way MLR 7 day | 0.0 | HPAEC TNF alpha + IL-1 beta | 51.8 |
| PBMC rest | 0.0 | Lung fibroblast none | 24.8 |
| PBMC PWM | 0.4 | Lung fibroblast TNF alpha + IL-1 beta | 6.7 |
| PBMC PHA-L | 0.3 | Lung fibroblast IL-4 | 41.8 |
| Ramos (B cell) none | 0.7 | Lung fibroblast IL-9 | 32.8 |
| Ramos (B cell) ionomycin | 1.4 | Lung fibroblast IL-13 | 89.5 |
| B lymphocytes PWM | 1.0 | Lung fibroblast IFN gamma | 69.3 |
| B lymphocytes CD40L and IL-4 | 0.6 | Dermal fibroblast CCD1070 rest | 100.0 |

TABLE 23G-continued

Panel 4D

| Tissue Name | Rel. Exp. (%) Ag1148, Run 145386435 | Tissue Name | Rel. Exp. (%) Ag1148, Run 145386435 |
|---|---|---|---|
| EOL-1 dbcAMP | 0.3 | Dermal fibroblast CCD1070 TNF alpha | 77.9 |
| EOL-1 dbcAMP PMA/ionomycin | 0.4 | Dermal fibroblast CCD1070 IL-1 beta | 95.3 |
| Dendritic cells none | 0.0 | Dermal fibroblast IFN gamma | 5.8 |
| Dendritic cells LPS | 0.0 | Dermal fibroblast IL-4 | 8.0 |
| Dendritic cells anti-CD40 | 0.1 | IBD Colitis 2 | 3.0 |
| Monocytes rest | 0.1 | IBD Crohn's | 5.3 |
| Monocytes LPS | 0.1 | Colon | 2.5 |
| Macrophages rest | 0.2 | Lung | 11.4 |
| Macrophages LPS | 0.0 | Thymus | 9.1 |
| HUVEC none | 49.3 | Kidney | 2.6 |
| HUVEC starved | 41.2 | | |

TABLE 23H

Panel 5 Islet

| Tissue Name | Rel. Exp.(%) Ag1148, Run 233070519 | Tissue Name | Rel. Exp.(%) Ag1148. Run 233070519 |
|---|---|---|---|
| 97457_Patient-02go_adipose | 6.2 | 94709_Donor 2 AM - A_adipose | 17.1 |
| 97476_Patient-07sk_skeletal muscle | 77.4 | 94710_Donor 2 AM - B_adipose | 3.0 |
| 97477_Patient-07ut_uterus | 14.7 | 94711_Donor 2 AM - C_adipose | 7.6 |
| 97478_Patient-07pl_placenta | 7.1 | 94712_Donor 2 AD - A_adipose | 35.8 |
| 99167_Bayer Patient 1 | 18.6 | 94713_Donor 2 AD - B_adipose | 37.4 |
| 97482_Patient-08ut_uterus | 5.8 | 94714_Donor 2 AD - C_adipose | 44.8 |
| 97483_Patient-08pl_planceta | 3.3 | 94742_Donor 3 U - A_Mesenchymal Stem Cells | 5.1 |
| 97486_Patient-09sk_skeletal muscle | 11.7 | 94743_Donor 3 U - B_Mesenchymal Stem Cells | 15.0 |
| 97487_Patient-09ut_uterus | 12.4 | 94730_Donor 3 AM - A_adipose | 15.2 |
| 97488_Patient-09pl_placenta | 1.9 | 94731_Donor 3 AM - B_adipose | 10.8 |
| 97492_Patient-10ut_uterus | 15.7 | 94732_Donor 3 AM - C_adipose | 11.7 |
| 97493_Patient-10pl_placenta | 3.5 | 94733_Donor 3 AD - A_adipose | 100.0 |
| 97495_Patient-11go_adipose | 41.2 | 94734_Donor 3 AD - B_adipose | 11.7 |
| 97496_Patient-11sk_skeletal muscle | 8.7 | 94735_Donor 3 AD - C_adipose | 44.8 |
| 97497_Patient-11ut_uterus | 12.8 | 77138_Liver_HepG2untreated | 15.0 |
| 97498_Patient-11pl_placenta | 3.1 | 73556_Heart_Cardiac stromal cells (primary) | 29.9 |
| 97500_Patient-12go_adipose | 72.2 | 81735_Small Intestine | 7.7 |
| 97501_Patient-12sk_skeletal muscle | 31.6 | 72409_Kidney_Proximal Convoluted Tubule | 5.5 |
| 97502_Patient-12ut_uterus | 12.2 | 82685_Small intestine_Duodenum | 5.0 |
| 97503_Patient-12pl_placenta | 4.5 | 90650_Adrenal_Adrenocortical adenoma | 2.4 |
| 94721_Donor 2 U - A_Mesenchymal Stem Cells | 36.1 | 72410_Kidney_HRCE | 46.0 |
| 94722_Donor 2 U - B_Mesenchymal Stem Cells | 12.2 | 72411_Kidney_HRE | 21.6 |
| 94723_Donor 2 U - C_Mesenchymal Stem Cells | 47.3 | 73139_Uterus_Uterine smooth muscle cells | 7.3 |

General_screening_panel_v1.5 Summary: Ag1148 The expression of the CG55688-01 gene appears to be highest in a sample derived from a melanoma cell line (Hs.688(A).T) (CT=32.2). Overall, significant expression is predominantly seen in cancer cell lines, including a related melanoma cell line (Hs.688(B).T), as well as a cluster of renal, ovarian and breast cancer cell lines. Thus, the expression of this gene could be used to distinguish Hs.688(A).T cells from the other samples in the panel. Moreover, therapeutic modulation of this gene, through the use of small molecule drugs, protein therapeutics or antibodies might be of benefit in the treatment of melanoma, renal cancer, breast cancer or ovarian cancer.

There is also significant expression in kidney (CT=33.2) when compared to expression in fetal kidney (CT=38.2). Thus, expression of this gene could be used to differentiate between adult and fetal kidney.

Panel 1.2 Summary: Ag1148 Two experiments with the same probe and primer set show highest expression of the CG55688-01 gene in fetal and adult heart (CTs=25). This gene has moderate to high expression in other metabolic tissues, including pancreas, adrenal, thyroid, pituitary, skeletal muscle and adult and fetal liver. This gene product belongs to the insulin-like growth factor binding protein family and, by homology, may play myriad roles in metabolic regulation. Therefore, this gene product may be a monoclonal antibody target for the treatment of metabolic and endocrine diseases, including obesity and Types 1 and 2 diabetes.

This panel shows that the expression of this gene within the CNS is the highest in the hippocampus. The hippocampus is a region of the brain critical for the formation of long-term memories. Please see panel 1.3d for a discussion of utility of this gene in the central nervous system.

There is also significant expression in lung (CTs=25–27) when compared to expression in fetal lung (CTs=29–30). Thus, expression of this gene could be used to differentiate between adult and fetal lung.

Panel 1.3D Summary: Ag1148 The expression of the CG55688-01 gene appears to be highest in a sample derived from a melanoma cell line (Hs.688(A).T) (CT=27). In addition, there appears to be substantial expression in a related melanoma cell line (Hs.688(B).T) as well as a cluster of brain cancer cell lines and renal cancer cell lines. This expression is consistent with expression in the previous panels. Thus, the expression of this gene could be used to distinguish Hs.688(A).T cells from the other samples in the panel. Moreover, therapeutic modulation of this gene, through the use of small molecule drugs, protein therapeutics or antibodies might be of benefit in the treatment of melanoma, renal cancer or brain cancer.

This panel shows significant expression of this gene in metabolic tissues, confirming expression seen in Panel 1.2. Please see that panel for discussion of the utility of this gene in metabolic disease.

In addition, this gene is expressed at low levels in several brain regions including hippocampus, cortex, substantia nigra, thalamus, amygdala, and the fetal brain. Cry61 is an immediate early gene that has been implicated in memory formation and synaptic plasticity. It has also been shown to be upregulated during the development of the hippocampus, which is a critical brain region for the formation of long-term memory. Based on its homology to Cry61 and its preferential expression in the hippocampus, this gene is therefore an excellent drug target for the treatment of dementia (Alzheimer's, vascular, etc) or for memory enhancement.

References:

Albrecht C, von Der, Kammer H, Mayhaus M, Klaudiny J, Schweizer M, Nitsch R M. Muscarinic acetylcholine receptors induce the expression of the immediate early growth regulatory gene CYR61. J Biol Chem Sep. 15, 2000;275(37):28929–36

In brain, muscarinic acetylcholine receptors (mAChRs) modulate neuronal functions including long term potentiation and synaptic plasticity in neuronal circuits that are involved in learning and memory formation. To identify mAChR-inducible genes, we used a differential display approach and found that mAChRs rapidly induced transcription of the immediate early gene CYR61 in HEK 293 cells with a maximum expression after 1 h of receptor stimulation. CYR61 is a member of the emerging CCN gene family that includes CYR61/CEF10, CTGF/FISP-12, and NOV; these encode secretory growth regulatory proteins with distinct functions in cell proliferation, migration, adhesion, and survival. We found that CYR61, CTGF, and NOV were expressed throughout the human central nervous system. Stimulation of mAChRs induced CYR61 expression in primary neurons and rat brain where CYR61 mRNA was detected in cortical layers V and VI and in thalamic nuclei. In contrast, CTGF and NOV expression was not altered by mAChRs neither in neuronal tissue culture nor rat brain. Receptor subtype analyses demonstrated that m1 and m3 mAChR subtypes strongly induced CYR61 expression, whereas m2 and m4 mAChRs had only subtle effects. Increased CYR61 expression was coupled to mAChRs by both protein kinase C and elevations of intracellular Ca(2+). Our results establish that CYR61 expression in mammalian brain is under the control of cholinergic neurotransmission; it may thus be involved in cholinergic regulation of synaptic plasticity.

Chung K C, Ahn Y S. Expression of immediate early gene cyr61 during the differentiation of immortalized embryonic hippocampal neuronal cells. Neurosci Lett Oct. 23, 1998;255(3):155–8

Growth factor-mediated signal transduction is a process that is of fundamental importance in understanding cellular growth and differentiation. In order to elucidate the signaling pathways leading to neuronal differentiation, we have tried to identify intermediates that are selectively induced in the differentiation of immortalized neuronal hippocampal cell line H19-7. In the present study we found that immediate early gene cyr61 is expressed in a rapid and transient manner by bFGF during the differentiation of H19-7 cells. To clarify the signal transduction pathway for the induction of cyr61 by bFGF, we checked whether Raf-1 and mitogen-activated protein kinase (MAPK) is activated during the induction of cyr61. It is identified that cyr61 is induced by bFGF via at least two signaling pathways; MAPK-dependent as well as MAPK-independent signaling pathways. This study suggested that cyr61 is likely to play an important role in neuronal differentiation process.

Panel 2D Summary: Ag1148 The expression of the CG55688-01 gene was assessed in two independent runs in panel 2D with excellent concordance between runs. The highest expression of this gene is found in normal bladder tissue and a kidney cancer sample (CTs=28). In addition, there appears to be substantial expression associated with ovarian derived tissue, prostate derived tissue and a number of kidney samples. Thus, the expression of this gene could be used to distinguish the bladder and kidney samples from the rest of the samples in the panel. Moreover, therapeutic modulation of this gene, through the use of small molecule drugs, protein therapeutics or antibodies might be beneficial in the treatment of kidney cancer, ovarian cancer or prostate cancer.

Panel 3D Summary: Ag1148 The expression of the CG55688-01 gene appears to be highest in a sample derived from a lung cancer (NCI-H292)(CT=28). In addition, there is substantial expression associated with a number of brain cancers, renal cancer cell lines, pancreatic cancer cell lines, bladder cancer cell lines and two sarcoma cell lines. Thus, the expression of this gene could be used to distinguish NCI-H292 cells from the other samples in the panel.

Panel 4D Summary: Ag1148 The CG55688-01 gene, a Cyr61 homolog, is expressed at moderate levels (CT range 28–32), in resting and cytokine-stimulated HUVEC, lung microvascular endothelial cells, coronary artery smooth muscle cells, bronchial epithelial cells, small airway epithelial cells, astrocytes, pulmonary artery endothelial cells, lung fibroblasts, and dermal fibroblasts. Based on the expression pattern above and our understanding of the functions of Cyr61 in vascular biology (see reference), it can be concluded that antibodies and small molecule antagonists that block the function of the CG55688-01 gene product may reduce or eliminate the symptoms in patients with any of several inflammatory or autoimmune diseases, including Crohn's disease, ulcerative colitis, multiple sclerosis, chronic obstructive pulmonary disease, asthma, emphysema, rheumatoid arthritis, or psoriasis.

References:

Babic A M, Kireeva M L, Kolesnikova T V, Lau L F CYR61, a product of a growth factor-inducible immediate early gene, promotes angiogenesis and tumor growth. Proc Natl Acad Sci USA May 26, 1998;95(11):6355–60

CYR61 is a secreted, cysteine-rich, heparin-binding protein encoded by a growth factor-inducible immediate-early gene. Acting as an extracellular, matrix-associated signaling molecule, CYR61 promotes the adhesion of endothelial cells through interaction with the integrin alphaVbeta3 and augments growth factor-induced DNA synthesis in the same cell type. In this study, we show that purified CYR61 stimulates directed migration of human microvascular endothelial cells in culture through an alphaV beta3-dependent pathway and induces neovascularization in rat corneas. Both the chemotactic and angiogenic activities of CYR61 can be blocked by specific anti-CYR61 antibodies. Whereas most human tumor-derived cell lines tested express CYR61, the gastric adenocarcinoma cell line RF-1 does not. Expression of the CYR61 cDNA under the regulation of a constitutive promoter in RF-1 cells significantly enhances the tumorigenicity of these cells as measured by growth in immunodeficient mice, resulting in tumors that are larger and more vascularized than those produced by control RF-1 cells. Taken together, these results identify CYR61 as an angiogenic inducer that can promote tumor growth and vascularization; the results also suggest potential roles for CYR61 in physiologic and pathologic neovascularization.

Panel 5 Islet Summary: Ag 1148 The CG55688-01 gene has low expression in islet tissue. It is also expressed at low levels in mesenchymal stem cells, which can be differentiated in vitro into adipocytes, chondrocytes and osteocytes. Therefore, this gene may be a monoclonal antibody target for the treatment of diseases involving adipose, cartilage or bone.

SEC6 (CG56157-01)

Expression of gene CG56157-01 was assessed using the primer-probe set Ag1102, described in Table 24A. Results of the RTQ-PCR runs are shown in Table 24B.

TABLE 24A

Probe Name Ag1102

| Primers | Sequences | | Length | Start Position |
|---|---|---|---|---|
| Forward | 5'-aggatccaggaaacgaagtg-3' | (SEQ ID NO:156) | 20 | 123 |
| Probe | TET-5'-tctacgcgctatataagcaggccactg-3'-TAMRA | (SEQ ID NO:157) | 27 | 153 |
| Reverse | 5'-gggcatgttacaaggtcctt-3' | (SEQ ID NO:158) | 20 | 180 |

TABLE 24B

Panel 1.2

| Tissue Name | Rel. Exp.(%) Ag1102, Run 125939695 | Tissue Name | Rel. Exp.(%) Ag1102, Run 125939695 |
|---|---|---|---|
| Endothelial cells | 12.3 | Renal ca. 786-0 | 3.4 |
| Heart (Fetal) | 6.3 | Renal ca. A498 | 5.4 |
| Pancreas | 16.4 | Renal ca. RXF 393 | 3.2 |
| Pancreatic ca. CAPAN 2 | 0.4 | Renal ca. ACHN | 4.8 |
| Adrenal Gland | 53.6 | Renal ca. UO-31 | 2.2 |
| Thyroid | 12.3 | Renal ca. TK-10 | 4.6 |
| Salivary gland | 16.3 | Liver | 29.9 |
| Pituitary gland | 13.4 | Liver (fetal) | 11.9 |
| Brain (fetal) | 4.4 | Liver ca. (hepatoblast) HepG2 | 16.6 |
| Brain (whole) | 7.9 | Lung | 4.0 |
| Brain (amygdala) | 4.2 | Lung (fetal) | 1.7 |
| Brain (cerebellum) | 7.5 | Lung ca. (small cell) LX-1 | 6.0 |
| Brain (hippocampus) | 14.6 | Lung ca. (small cell) NCI-H69 | 2.0 |
| Brain (thalamus) | 4.4 | Lung ca. (s. cell var.) SHP-77 | 3.0 |
| Cerebral Cortex | 7.0 | Lung ca. (large cell) NCI-H460 | 10.6 |
| Spinal cord | 2.7 | Lung ca. (non-sm. cell) A549 | 9.6 |
| glio/astro U87-MG | 3.6 | Lung ca. (non-s.cell) NCI-H23 | 4.1 |
| glio/astro U-118-MG | 6.4 | Lung ca. (non-s.cell) HOP-62 | 11.6 |
| astrocytoma SW1783 | 4.0 | Lung ca. (non-s.cl) NCI-H522 | 38.7 |
| neuro*; met SK-N-AS | 6.9 | Lung ca. (squam.) SW 900 | 12.2 |
| astrocytoma SF-539 | 3.7 | Lung ca. (squam.) NCI-H596 | 3.0 |
| astrocytoma SNB-75 | 1.1 | Mammary gland | 5.6 |
| glioma SNB-19 | 3.0 | Breast ca.* (pl.ef) MCF-7 | 3.3 |

TABLE 24B-continued

Panel 1.2

| Tissue Name | Rel. Exp.(%) Ag1102, Run 125939695 | Tissue Name | Rel. Exp.(%) Ag1102, Run 125939695 |
|---|---|---|---|
| glioma U251 | 1.7 | Breast ca.* (pl.ef) MDA-MB-231 | 6.2 |
| glioma SF-295 | 4.6 | Breast ca.* (pl.ef) T47D | 9.6 |
| Heart | 32.5 | Breast ca. BT-549 | 12.2 |
| Skeletal Muscle | 100.0 | Breast ca. MDA-N | 1.5 |
| Bone marrow | 2.9 | Ovary | 4.4 |
| Thymus | 1.1 | Ovarian ca. OVCAR-3 | 1.4 |
| Spleen | 1.3 | Ovarian ca. OVCAR-4 | 15.6 |
| Lymph node | 2.0 | Ovarian ca. OVCAR-5 | 4.7 |
| Colorectal Tissue | 2.1 | Ovarian ca. OVCAR-8 | 9.5 |
| Stomach | 14.5 | Ovarian ca. IGROV-1 | 5.4 |
| Small intestine | 6.9 | Ovarian ca. (ascites) SK-OV-3 | 9.4 |
| Colon ca. SW480 | 1.7 | Uterus | 6.4 |
| Colon ca.* SW620 (SW480 met) | 5.0 | Placenta | 10.7 |
| Colon ca. HT29 | 0.3 | Prostate | 14.5 |
| Colon ca. HCT-116 | 6.0 | Prostate ca.* (bone met) PC-3 | 57.0 |
| Colon ca. CaCo-2 | 5.8 | Testis | 14.1 |
| Colon ca. Tissue (ODO3866) | 0.6 | Melanoma Hs688(A).T | 3.3 |
| Colon ca. HCC-2998 | 2.7 | Melanoma* (met) Hs688(B).T | 3.4 |
| Gastric ca.* (liver met) NCI-N87 | 3.2 | Melanoma UACC-62 | 13.8 |
| Bladder | 16.7 | Melanoma M14 | 9.9 |
| Trachea | 1.8 | Melanoma LOX IMVI | 24.8 |
| Kidney | 43.2 | Melanoma* (met) SK-MEL-5 | 19.5 |
| Kidney (fetal) | 8.1 | | |

Panel 1.2 Summary: Ag1102 Highest expression of the CG56157-01 gene is seen in skeletal muscle (CT=24), with high levels of expression also seen in pancreas, adrenal, pituitary, heart, and liver. Diazepam binding inhibitor (DBI) is a 10-kDa polypeptide that regulates mitochondrial steroidogenesis, glucose-induced insulin secretion, metabolism of acyl-CoA esters, fatty acid oxidation, and the action of gamma-aminobutyrate on GABAA receptors. This gene, a DBI-related protein, may thus be a small molecule target for the treatment of metabolic and endocrine diseases, including obesity and Types 1 and 2 diabetes.

This gene also expressed at high levels in all CNS regions examined. The diazepam binding inhibitor has been implicated in seizure disorders, drug dependence and memory. In addition, this ligand acts at the GABA-A receptor which has been implicated in schizophrenia and bipolar disorder. Therefore, therapeutic modulation of this gene, a diazepam binding inhibitor homolog, may be of use in any of these clinical conditions.

References:

Kolmer M, Alho H, Costa E, Pani L. Cloning and tissue-specific functional characterization of the promoter of the rat diazepam binding inhibitor, a peptide with multiple biological actions. Proc Natl Acad Sci USA. Sep. 15, 1993;90(18):8439–43.

Diazepam binding inhibitor (DBI) is a 10-kDa polypeptide that regulates mitochondrial steroidogenesis, glucose-induced insulin secretion, metabolism of acyl-CoA esters, and the action of gamma-aminobutyrate on GABAA receptors. To investigate the regulation of DBI gene expression, three positive clones were isolated from a rat genomic library. One of them contained a DBI genomic DNA fragment encompassing 4 kb of the 5' untranslated region, the first two exons, and part of the second intron of the DBI gene. Two other overlapping clones contained a processed DBI pseudogene. Several transcription initiation sites were detected by RNase protection and primer extension assays. Different tissues exhibited clear differences in the efficiencies of transcription startpoint usage. Transient expression experiments using DNA fragments of different length from the 5' untranslated region of the DBI gene showed that basal promoter activity required 146 bp of the proximal DBI sequence, whereas full activation was achieved with 423 bp of the 5' untranslated region. DNase I protection experiments with liver nuclear proteins demonstrated three protected regions at nt-387 to -333, -295 to -271, and -176 to -139 relative to the ATG initiation codon; in other tissues the pattern of protection was different. In gel shift assays the most proximal region (-176 to -139) was found to bind several general transcription factors as well as cell type-restricted nuclear proteins which may be related to specific regulatory patterns in different tissues. Thus, the DBI gene possesses some features of a housekeeping gene but also includes a variable regulation which appears to change with the function that it subserves in different cell types.

PMID: 7690962

Ferrarese C, Cogliati T, Tortorella R, Zucca C, Bogliun G, Beghi E, Passoni D, Zola C, Begni B, Airoldi L, Alho H, Frattola L. Diazepam binding inhibitor (DBI) in the plasma of pediatric and adult epileptic patients. Epilepsy Res 1998 January;29(2):129–34

The polypeptide diazepam binding inhibitor (DBI) displays epileptogenic activity by binding to benzodiazepine receptors. We analyzed DBI concentrations in the plasma of pediatric and adult epileptic patients, as a possible peripheral marker in epilepsy. DBI plasma concentrations are significantly higher (+62%, P<0.001) in adult patients and slightly but significantly higher (+15%, P<0.01) in pediatric patients, compared to age-related controls. Strikingly, plasma DBI is much higher (+81%, P<0.001) in generalized epilepsy in adults and in drug-resistant pediatric and adult patients. Based on these findings, plasma DBI may be considered as a peripheral biological marker of epilepsy and, in association with lymphocyte benzodiazepine receptor density, of anticonvulsant drug responsiveness.

Herzog C D, Stackman R W, Walsh T J. Intraseptal flumazenil enhances, while diazepam binding inhibitor impairs, performance in a working memory task. Neurobiol Learn Mem 1996 November;66(3):341–52

GABAA/benzodiazepine receptors in the medial septum modulate the activity of cholinergic neurons that innervate the hippocampus. Injection of benzodiazepine (BDZ) agonists into the medial septum impairs working memory performance and decreases high-affinity choline transport (HAChT) in the hippocampus. In contrast, intraseptal injection of the BDZ antagonist flumazenil increases HAChT and prevents the memory deficits induced by systemic BDZs. The present studies attempted to further characterize the behavioral effects of medial septal injections of flumazenil to an endogenous negative modulator of the GABAA/BDZ receptor complex, diazepam binding inhibitor (DBI). Male Sprague-Dawley rats were cannulated to study the effects of intraseptal injections of these BDZ ligands on spatial working memory, anxiety-related behaviors in the elevated plus maze, and on general locomotor activity. Intraseptal flumazenil (10 nmol/0.5 microliter) produced a delay-dependent enhancement of DNMTS performance after an 8-h, but not a 4-h, delay interval. This promnestic dose of flumazenil had no effect on locomotor activity and did not produce changes in measures of anxiety on the plus maze. Intraseptal injection of DBI had no effect (8 nmol/0.5 microliter) or slightly impaired (4 nmol/0.5 microliter) DNMTS radial maze performance following an 8-h delay, without producing changes in locomotion or plus maze behavior. These data demonstrate that flumazenil has a unique profile of activity in enhancing working memory following intraseptal injection.

Ohkuma S, Katsura M, Tsujimura A. Alterations in cerebral diazepam binding inhibitor expression in drug dependence: a possible biochemical alteration common to drug dependence. Life Sci Feb. 2, 2001;68(11):1215–22

Mechanisms for formation of drug dependence and expression of withdrawal syndrome have not fully clarified despite of huge accumulation of experimental and clinical data at present. Several clinical features of withdrawal syndrome are considered to be common among patients with drug dependence induced by different drugs of abuse. One of them is anxiety. Recent investigations have revealed that diazepam binding inhibitor (DBI), a peptide consisting of 87 amino acids with molecular weight of about 10 kDa, serves as an inverse agonist for benzodiazepine (BZD) receptors with endogenously anxiogenic potential. These lines of data suggest that cerebral DBI expression in brain may participates in formation of drug dependence and/or emergence of withdrawal syndrome. Based on this working hypothesis, we have examined DBI expression in the brain derived from mice depended on alcohol (ethanol), nicotine, and morphine to investigate functional relationship between cerebral DBI expression and drug dependence. Cerebral DBI expression significantly increases in animals with drug dependence induced by these drugs, and in the cases of nicotine- and morphine-dependent mice concomitant administration of antagonists for nicotinic acetylcholine and opioid receptors, respectively, abolished the increase. Abrupt cessation of administration of drugs facilitated further increase in DBI expression. Therefore, these alterations in DBI expression have close relationship with formation of drug dependence and/or emergence of withdrawal syndrome, and are considered to be a common biochemical process in drug dependence induced by different drugs of abuse. Finding and elucidation of mechanisms for common biochemical alterations among drug dependence may provide a clue to clarify mechanisms for formation of drug dependence and/or emergence of withdrawal syndrome.

SEC2 (CG54933-01)

Expression of gene CG54933-01 was assessed using the primer-probe set Ag2044, described in Table 25A. Results of the RTQ-PCR runs are shown in Tables 25B, 25C, 25D, 25E and 25F.

TABLE 25A

Probe Name Ag2044

| Primers | Sequences | | Length | Start Position |
|---|---|---|---|---|
| Forward | 5'-gcagctggacgtcctctatc-3' | (SEQ ID NO:159) | 20 | 1530 |
| Probe | TET-5'-ccagaacatgaacgggtccgaatact-3'-TAMRA | (SEQ ID NO:160) | 26 | 1569 |
| Reverse | 5'-ccaggaaggactggatcttc-3' | (SEQ ID NO:161) | 20 | 1599 |

TABLE 25B

General_screening_panel_v1.4

| Tissue Name | Rel. Exp.(%) Ag2044, Run 208014892 | Tissue Name | Rel. Exp.(%) Ag2044, Run 208014892 |
|---|---|---|---|
| Adipose | 2.7 | Renal ca. TK-10 | 0.0 |
| Melanoma* Hs688(A).T | 0.0 | Bladder | 4.5 |
| Melanoma* Hs688(B).T | 0.0 | Gastric ca. (liver met.) NCI-N87 | 100.0 |
| Melanoma* M14 | 0.0 | Gastric ca. KATO III | 17.2 |
| Melanoma* LOXIMVI | 0.0 | Colon ca. SW-948 | 13.0 |
| Melanoma* SK-MEL-5 | 0.0 | Colon ca. SW480 | 2.3 |
| Squamous cell carcinoma SCC-4 | 2.9 | Colon ca.* (SW480 met) SW620 | 3.7 |

TABLE 25B-continued

General_screening_panel_v1.4

| Tissue Name | Rel. Exp.(%) Ag2044, Run 208014892 | Tissue Name | Rel. Exp.(%) Ag2044, Run 208014892 |
|---|---|---|---|
| Testis Pool | 0.2 | Colon ca. HT29 | 0.4 |
| Prostate ca.* (bone met) PC-3 | 0.3 | Colon ca. HCT-116 | 5.0 |
| Prostate Pool | 0.0 | Colon ca. CaCo-2 | 0.2 |
| Placenta | 0.5 | Colon cancer tissue | 7.2 |
| Uterus Pool | 0.4 | Colon ca. SW1116 | 5.8 |
| Ovarian ca. OVCAR-3 | 25.3 | Colon ca. Colo-205 | 1.4 |
| Ovarian ca. SK-OV-3 | 3.6 | Colon ca. SW-48 | 2.0 |
| Ovarian ca. OVCAR-4 | 0.7 | Colon Pool | 1.5 |
| Ovarian ca. OVCAR-5 | 3.9 | Small Intestine Pool | 0.6 |
| Ovarian ca. IGROV-1 | 0.2 | Stomach Pool | 0.1 |
| Ovarian ca. OVCAR-8 | 64.6 | Bone Marrow Pool | 0.4 |
| Ovary | 1.9 | Fetal Heart | 0.2 |
| Breast ca. MCF-7 | 0.0 | Heart Pool | 0.3 |
| Breast ca. MDA-MB-231 | 2.5 | Lymph Node Pool | 1.2 |
| Breast ca. BT 549 | 0.2 | Fetal Skeletal Muscle | 0.0 |
| Breast ca. T47D | 5.5 | Skeletal Muscle Pool | 0.0 |
| Breast ca. MDA-N | 0.0 | Spleen Pool | 0.0 |
| Breast Pool | 0.8 | Thymus Pool | 0.0 |
| Trachea | 3.3 | CNS cancer (glio/astro) U87-MG | 0.0 |
| Lung | 0.1 | CNS cancer (glio/astro) U-118-MG | 0.0 |
| Fetal Lung | 10.7 | CNS cancer (neuro; met) SK-N-AS | 0.0 |
| Lung ca. NCI-N417 | 0.0 | CNS cancer (astro) SF-539 | 0.0 |
| Lung ca. LX-1 | 23.2 | CNS cancer (astro) SNB-75 | 0.1 |
| Lung ca. NCI-H146 | 0.0 | CNS cancer (glio) SNB-19 | 0.1 |
| Lung ca. SHP-77 | 0.0 | CNS cancer (glio) SF-295 | 0.0 |
| Lung ca. A549 | 0.2 | Brain (Amygdala) Pool | 0.1 |
| Lung ca. NCI-H526 | 0.0 | Brain (cerebellum) | 0.1 |
| Lung ca. NCI-H23 | 0.0 | Brain (fetal) | 0.0 |
| Lung ca. NCI-H460 | 0.0 | Brain (Hippocampus) Pool | 0.2 |
| Lung ca. HOP-62 | 0.2 | Cerebral Cortex Pool | 0.1 |
| Lung ca. NCI-H522 | 0.1 | Brain (Substantia nigra) Pool | 0.1 |
| Liver | 0.0 | Brain (Thalamus) Pool | 0.0 |
| Fetal Liver | 0.1 | Brain (whole) | 0.0 |
| Liver ca. HepG2 | 1.1 | Spinal Cord Pool | 0.2 |
| Kidney Pool | 0.7 | Adrenal Gland | 0.0 |
| Fetal Kidney | 0.6 | Pituitary gland Pool | 0.0 |
| Renal ca. 786-0 | 0.0 | Salivary Gland | 0.1 |
| Renal ca. A498 | 0.1 | Thyroid (female) | 0.0 |
| Renal ca. ACHN | 0.0 | Pancreatic ca. CAPAN2 | 67.4 |
| Renal ca. UO-31 | 0.4 | Pancreas Pool | 1.3 |

TABLE 25C

Panel 1.3D

| Tissue Name | Rel. Exp.(%) Ag2044, Run 150924718 | Rel. Exp.(%) Ag2044, Run 151268419 | Tissue Name | Rel. Exp.(%) Ag2044, Run 150924718 | Rel. Exp.(%) Ag2044, Run 151268419 |
|---|---|---|---|---|---|
| Liver adenocarcinoma | 72.2 | 50.3 | Kidney (fetal) | 4.8 | 2.2 |
| Pancreas | 0.1 | 0.5 | Renal ca. 786-0 | 0.0 | 0.0 |
| Pancreatic ca. CAPAN 2 | 38.7 | 43.5 | Renal ca. A498 | 0.2 | 0.1 |
| Adrenal gland | 0.0 | 0.1 | Renal ca. RXF 393 | 0.0 | 0.0 |
| Thyroid | 0.0 | 0.0 | Renal ca. ACHN | 0.1 | 0.4 |
| Salivary gland | 0.8 | 0.2 | Renal ca. UO-31 | 0.2 | 0.1 |
| Pituitary gland | 0.2 | 0.4 | Renal ca. TK-10 | 0.0 | 0.0 |
| Brain (fetal) | 0.0 | 0.0 | Liver | 0.0 | 0.0 |
| Brain (whole) | 0.2 | 0.5 | Liver (fetal) | 0.4 | 0.0 |
| Brain (amygdala) | 0.9 | 0.5 | Liver ca. (hepatoblast) HepG2 | 1.1 | 1.1 |
| Brain (cerebellum) | 0.0 | 0.0 | Lung | 28.9 | 17.1 |

TABLE 25C-continued

Panel 1.3D

| Tissue Name | Rel. Exp.(%) Ag2044, Run 150924718 | Rel. Exp.(%) Ag2044, Run 151268419 | Tissue Name | Rel. Exp.(%) Ag2044, Run 150924718 | Rel. Exp.(%) Ag2044, Run 151268419 |
|---|---|---|---|---|---|
| Brain (hippocampus) | 1.6 | 1.6 | Lung (fetal) | 57.4 | 40.9 |
| Brain (substantianigra) | 1.5 | 0.4 | Lung ca. (small cell) LX-1 | 20.6 | 17.6 |
| Brain (thalamus) | 0.6 | 0.6 | Lung ca. (small cell) NCI-H69 | 0.0 | 0.0 |
| Cerebral Cortex | 0.2 | 0.1 | Lung ca. (s.cell var.) SHP-77 | 0.0 | 0.0 |
| Spinal cord | 0.3 | 0.4 | Lung ca. (large cell) NCI-H460 | 0.0 | 0.0 |
| glio/astro U87-MG | 0.0 | 0.0 | Lung ca. (non-sm. cell) A549 | 0.0 | 0.1 |
| glio/astro U-118-MG | 0.0 | 0.0 | Lung ca. (non-s.cell) NCI-H23 | 0.2 | 0.0 |
| astrocytoma SW1783 | 0.0 | 0.0 | Lung ca. (non-s.cell) HOP-62 | 0.7 | 0.3 |
| neuro*; met SK-N-AS | 0.0 | 0.0 | Lung ca. (non-s.cl) NCI-H522 | 0.9 | 0.5 |
| astrocytoma SF-539 | 0.0 | 0.1 | Lung ca. (squam.) SW 900 | 0.0 | 0.0 |
| astrocytoma SNB-75 | 0.0 | 0.0 | Lung ca. (squam.) NCI-H596 | 0.0 | 0.0 |
| glioma SNB-19 | 0.4 | 0.0 | Mammary gland | 0.3 | 0.4 |
| glioma U251 | 0.0 | 0.0 | Breast ca.* (pl.ef) MCF-7 | 0.0 | 0.0 |
| glioma SF-295 | 0.4 | 0.1 | Breast ca.* (pl.ef) MDA-MB-231 | 6.4 | 3.1 |
| Heart (fetal) | 2.7 | 3.5 | Breast ca.* (pl.ef) T47D | 0.0 | 0.1 |
| Heart | 1.9 | 0.2 | Breast ca. BT-549 | 4.2 | 3.6 |
| Skeletal muscle (fetal) | 0.2 | 0.2 | Breast ca. MDA-N | 0.0 | 0.0 |
| Skeletal muscle | 0.0 | 0.0 | Ovary | 12.2 | 10.2 |
| Bone marrow | 0.0 | 0.0 | Ovarian ca. OVCAR-3 | 9.3 | 8.8 |
| Thymus | 0.2 | 0.2 | Ovarian ca. OVCAR-4 | 0.8 | 0.4 |
| Spleen | 1.5 | 0.4 | Ovarian ca. OVCAR-5 | 2.1 | 2.8 |
| Lymph node | 0.0 | 0.4 | Ovarian ca. OVCAR-8 | 37.6 | 26.6 |
| Colorectal | 1.8 | 1.9 | Ovarian ca. IGROV-1 | 0.0 | 0.0 |
| Stomach | 3.0 | 1.9 | Ovarian ca.* (ascites) SK-OV-3 | 2.0 | 1.3 |
| Small intestine | 4.7 | 5.1 | Uterus | 2.9 | 1.4 |
| Colon ca. SW480 | 6.0 | 3.2 | Placenta | 7.6 | 5.5 |
| Colon ca.* SW620(SW480 met) | 2.0 | 2.2 | Prostate | 0.8 | 0.8 |
| Colon ca. HT29 | 0.3 | 0.3 | Prostate ca.* (bone met)PC-3 | 0.2 | 0.3 |
| Colon ca. HCT-116 | 1.8 | 0.9 | Testis | 0.7 | 1.7 |
| Colon ca. CaCo-2 | 0.2 | 0.3 | Melanoma Hs688(A).T | 0.0 | 0.1 |
| Colon ca. tissue(ODO3866) | 8.0 | 6.8 | Melanoma* (met) Hs688(B).T | 0.0 | 0.0 |
| Colon ca. HCC-2998 | 18.7 | 15.0 | Melanoma UACC-62 | 0.0 | 0.0 |
| Gastric ca.* (liver met) NCI-N87 | 100.0 | 100.0 | Melanoma M14 | 0.0 | 0.0 |
| Bladder | 4.7 | 2.4 | Melanoma LOX IMVI | 0.0 | 0.0 |
| Trachea | 48.6 | 31.9 | Melanoma* (met) SK-MEL-5 | 0.0 | 0.0 |
| Kidney | 0.4 | 0.4 | Adipose | 18.0 | 18.0 |

TABLE 25D

Panel 2D

| Tissue Name | Rel. Exp. (%) Ag2044, Run 150925245 | Rel. Exp. (%) Ag2044, Run 151268239 | Tissue Name | Rel. Exp. (%) Ag2044, Run 150925245 | Rel. Exp. (%) Ag2044, Run 151268239 |
|---|---|---|---|---|---|
| Normal Colon | 0.1 | 0.2 | Kidney Margin 8120608 | 0.3 | 0.1 |
| CC Well to Mod Diff (ODO3866) | 3.4 | 3.3 | Kidney Cancer 8120613 | 0.0 | 0.0 |
| CC Margin (ODO3866) | 0.1 | 0.3 | Kidney Margin 8120614 | 0.6 | 0.8 |
| CC Gr.2 rectosigmoid (ODO3868) | 0.3 | 0.5 | Kidney Cancer 9010320 | 3.8 | 5.0 |
| CC Margin (ODO3868) | 0.0 | 0.0 | Kidney Margin 9010321 | 0.0 | 0.2 |
| CC Mod Diff (ODO3920) | 0.4 | 0.2 | Normal Uterus | 0.3 | 0.4 |
| CC Margin (ODO3920) | 0.3 | 0.7 | Uterus Cancer 064011 | 1.7 | 2.7 |
| CC Gr.2 ascend colon(ODO3921) | 3.1 | 3.7 | Normal Thyroid | 0.0 | 0.0 |
| CC Margin (ODO3921) | 0.4 | 0.7 | Thyroid Cancer 064010 | 0.0 | 0.0 |
| CC from Partial Hepatectomy (ODO4309) Mets | 24.8 | 28.7 | Thyroid Cancer A302152 | 0.0 | 0.0 |
| Liver Margin (ODO4309) | 0.0 | 0.0 | Thyroid Margin A302153 | 0.0 | 0.1 |
| Colon mets to lung (OD04451-01) | 0.4 | 0.7 | Normal Breast | 0.0 | 0.0 |
| Lung Margin (OD04451-02) | 2.4 | 2.2 | Breast Cancer (OD04566) | 0.1 | 0.0 |
| Normal Prostate 6546-1 | 0.3 | 0.7 | Breast Cancer (OD04590-01) | 0.0 | 0.0 |
| Prostate Cancer (OD04410) | 0.0 | 0.0 | Breast Cancer Mets (OD04590-03) | 0.0 | 0.0 |
| Prostate Margin (OD04410) | 0.0 | 0.2 | Breast Cancer Metastasis (OD04655-05) | 0.2 | 0.2 |
| Prostate Cancer (OD04720-01) | 2.8 | 3.1 | Breast Cancer 064006 | 1.2 | 1.0 |
| Prostate Margin (OD04720-02) | 1.6 | 1.0 | Breast Cancer 1024 | 0.0 | 0.1 |
| Normal Lung 061010 | 6.0 | 6.1 | Breast Cancer 9100266 | 0.0 | 0.1 |
| Lung Met to Muscle (ODO4286) | 1.4 | 1.1 | Breast Margin 9100265 | 0.0 | 0.1 |
| Muscle Margin (ODO4286) | 0.0 | 0.1 | Breast Cancer A209073 | 0.0 | 0.0 |
| Lung Malignant Cancer (OD03126) | 10.6 | 11.7 | Breast Margin A2090734 | 0.0 | 0.0 |
| Lung Margin (OD03126) | 10.9 | 14.5 | Normal Liver | 0.0 | 0.0 |
| Lung Cancer (OD04404) | 1.7 | 3.1 | Liver Cancer 064003 | 0.1 | 0.0 |
| Lung Margin (OD04404) | 12.7 | 16.4 | Liver Cancer 1025 | 0.0 | 0.0 |
| Lung Cancer (OD04565) | 0.0 | 0.0 | Liver Cancer 1026 | 0.0 | 0.0 |
| Lung Margin (OD04565) | 3.2 | 4.7 | Liver Cancer 6004-T | 0.0 | 0.0 |
| Lung Cancer (OD04237-01) | 0.1 | 0.4 | Liver Tissue 6004-N | 0.0 | 0.0 |
| Lung Margin (OD04237-02) | 2.7 | 3.3 | Liver Cancer 6005-T | 0.0 | 0.0 |
| Ocular Mel Met to Liver (ODO4310) | 0.0 | 0.0 | Liver Tissue 6005-N | 0.0 | 0.0 |
| Liver Margin (ODO4310) | 0.0 | 0.0 | Normal Bladder | 3.1 | 4.8 |
| Melanoma Mets to Lung (OD04321) | 0.1 | 0.0 | Bladder Cancer 1023 | 5.6 | 7.7 |
| Lung Margin (OD04321) | 5.1 | 5.0 | Bladder Cancer A302173 | 0.3 | 0.3 |
| Normal Kidney | 0.6 | 0.7 | (Bladder Cancer (OD04718-01) | 0.6 | 0.9 |
| Kidney Ca, Nuclear | 0.1 | 0.0 | Bladder Normal | 0.0 | 0.0 |

TABLE 25D-continued

Panel 2D

| Tissue Name | Rel. Exp. (%) Ag2044, Run 150925245 | Rel. Exp. (%) Ag2044, Run 151268239 | Tissue Name | Rel. Exp. (%) Ag2044, Run 150925245 | Rel. Exp. (%) Ag2044, Run 151268239 |
|---|---|---|---|---|---|
| grade 2 (OD04338) | | | Adjacent (OD04718-03) | | |
| Kidney Margin (OD04338) | 0.2 | 0.2 | Normal Ovary | 2.6 | 3.9 |
| Kidney Ca Nuclear grade 1/2 (OD04339) | 0.0 | 0.0 | Ovarian Cancer 064008 | 20.9 | 24.3 |
| Kidney Margin (OD04339) | 0.2 | 0.2 | Ovarian Cancer (OD04768-07) | 100.0 | 100.0 |
| Kidney Ca, Clear cell type (OD04340) | 0.4 | 0.4 | Ovary Margin (OD04768-08) | 0.8 | 1.9 |
| Kidney Margin (OD04340) | 0.0 | 0.3 | Normal Stomach | 0.1 | 0.1 |
| Kidney Ca, Nuclear grade 3 (OD04348) | 0.0 | 0.0 | Gastric Cancer 9060358 | 0.3 | 0.7 |
| Kidney Margin (OD04348) | 0.2 | 0.4 | Stomach Margin 9060359 | 0.1 | 0.2 |
| Kidney Cancer (OD04622-01) | 8.2 | 12.9 | Gastric Cancer 9060395 | 17.1 | 18.7 |
| Kidney Margin (OD04622-03) | 0.1 | 0.3 | Stomach Margin 9060394 | 11.6 | 13.5 |
| Kidney Cancer (OD04450-01) | 0.1 | 0.3 | Gastric Cancer 9060397 | 24.3 | 29.3 |
| Kidney Margin (OD04450-03) | 0.2 | 0.2 | Stomach Margin 9060396 | 0.8 | 1.3 |
| Kidney Cancer 8120607 | 0.0 | 0.0 | Gastric Cancer 064005 | 0.6 | 0.9 |

TABLE 25E

Panel 3D

| Tissue Name | Rel. Exp.(%) Ag2044, Run 170745401 | Tissue Name | Rel. Exp.(%) Ag2044, Run 170745401 |
|---|---|---|---|
| Daoy- Medulloblastoma | 0.0 | Ca Ski- Cervical epidermoid carcinoma (metastasis) | 17.2 |
| TE671- Medulloblastoma | 0.0 | ES-2- Ovarian clear cell carcinoma | 0.0 |
| D283 Med- Medulloblastoma | 0.0 | Ramos- Stimulated with PMA/ionomycin 6h | 0.1 |
| PFSK-1- Primitive Neuroectodermal | 0.0 | Ramos- Stimulated with PMA/ionomycin 14h | 0.0 |
| XF-498- CNS | 0.0 | MEG-01- Chronic myelogenous leukemia (megokaryoblast) | 0.0 |
| SNB-78- Glioma | 0.0 | Raji- Burkitt's lymphoma | 0.0 |
| SF-268- Glioblastoma | 0.1 | Daudi- Burkitt's lymphoma | 0.0 |
| T98G- Glioblastoma | 0.0 | U266- B-cell plasmacytoma | 0.0 |
| SK-N-SH- Neuroblastoma (metastasis) | 0.0 | CA46- Burkitt's lymphoma | 0.0 |
| SF-295- Glioblastoma | 0.0 | RL- non-Hodgkin's B-cell lymphoma | 0.0 |
| Cerebellum | 0.0 | JMI- pre-B-cell lymphoma | 0.5 |
| Cerebellum | 0.0 | Jurkat- T cell leukemia | 0.0 |
| NCI-H292- Mucoepidermoid lung carcinoma | 44.4 | TF-1- Erythroleukemia | 0.0 |
| DMS-114- Small cell lung cancer | 0.0 | HUT 78- T-cell lymphoma | 0.0 |
| DMS-79- Small cell lung cancer | 100.0 | U937- Histiocytic lymphoma | 0.0 |
| NCI-H146- Small cell lung cancer | 0.0 | KU-812- Myelogenous leukemia | 0.0 |
| NCI-H526- Small cell lung cancer | 0.0 | 769-P- Clear cell renal carcinoma | 0.0 |
| NCI-N417- Small cell lung cancer | 0.0 | Caki-2- Clear cell renal carcinoma | 0.0 |
| NCI-H82- Small cell lung cancer | 0.0 | SW 839- Clear cell renal carcinoma | 0.0 |
| NCI-H157- Squamous cell lung cancer (metastasis) | 0.0 | G401- Wilms' tumor | 0.1 |

TABLE 25E-continued

Panel 3D

| Tissue Name | Rel. Exp.(%) Ag2044, Run 170745401 | Tissue Name | Rel. Exp.(%) Ag2044, Run 170745401 |
|---|---|---|---|
| NCI-H1155- Large cell lung cancer | 0.0 | Hs766T- Pancreatic carcinoma (LN metastasis) | 14.1 |
| NCI-H1299- Large cell lung cancer | 0.0 | CAPAN-1- Pancreatic adenocarcinoma (liver metastasis) | 2.0 |
| NCI-H727- Lung carcinoid | 0.0 | SU86.86- Pancreatic carcinoma (liver metastasis) | 0.5 |
| NCI-UMC-11- Lung carcinoid | 0.0 | BxPC-3- Pancreatic adenocarcinoma | 13.6 |
| LX-1- Small cell lung cancer | 40.6 | HPAC- Pancreatic adenocarcinoma | 34.6 |
| Colo-205- Colon cancer | 7.4 | MIA PaCa-2- Pancreatic carcinoma | 0.1 |
| KM12- Colon cancer | 0.0 | CFPAC-1- Pancreatic ductal adenocarcinoma | 19.9 |
| KM20L2- Colon cancer | 11.7 | PANC-1- Pancreatic epithelioid ductal carcinoma | 0.6 |
| NCI-H716- Colon cancer | 0.0 | T24- Bladder carcinoma (transitional cell) | 0.1 |
| SW-48- Colon adenocarcinoma | 4.5 | 5637- Bladder carcinoma | 0.3 |
| SW1116- Colon adenocarcinoma | 17.6 | HT-1197- Bladder carcinoma | 0.1 |
| LS 174T- Colon adenocarcinoma | 72.7 | UM-UC-3- Bladder carcinoma (transitional cell) | 0.0 |
| SW-948- Colon adenocarcinoma | 3.1 | A204- Rhabdomyosarcoma | 0.0 |
| SW-480- Colon adenocarcinoma | 0.4 | HT-1080- Fibrosarcoma | 0.0 |
| NCI-SNU-5- Gastric carcinoma | 5.1 | MG-63- Osteosarcoma | 0.1 |
| KATO III- Gastric carcinoma | 0.0 | SK-LMS-1- Leiomyosarcoma (vulva) | 0.0 |
| NCI-SNU-16- Gastric carcinoma | 0.0 | SJRH30- Rhabdomyosarcoma (met to bone marrow) | 0.0 |
| NCI-SNU-1- Gastric carcinoma | 0.1 | A431- Epidermoid carcinoma | 0.0 |
| RF-1- Gastric adenocarcinoma | 0.0 | WM266-4- Melanoma | 0.0 |
| RF-48- Gastric adenocarcinoma | 0.0 | DU 145- Prostate carcinoma (brain metastasis) | 0.0 |
| MKN-45- Gastric carcinoma | 22.5 | MDA-MB-468- Breast adenocarcinoma | 0.0 |
| NCI-N87- Gastric carcinoma | 53.6 | SCC-4- Squamous cell carcinoma of tongue | 0.0 |
| OVCAR-5- Ovarian carcinoma | 4.8 | SCC-9- Squamous cell carcinoma of tongue | 0.0 |
| RL95-2- Uterine carcinoma | 8.0 | SCC-15- Squamous cell carcinoma of tongue | 0.0 |
| HelaS3- Cervical adenocarcinoma | 18.6 | CAL 27- Squamous cell carcinoma of tongue | 0.2 |

TABLE 25F

Panel 4D

| Tissue Name | Rel. Exp. (%) Ag2044, Run 150925280 | Rel. Exp. (%) Ag2044, Run 151536254 | Tissue Name | Rel. Exp. (%) Ag2044, Run 150925280 | Rel. Exp. (%) Ag2044, Run 151536254 |
|---|---|---|---|---|---|
| Secondary Th1 act | 0.0 | 0.0 | HUVEC IL-1beta | 0.1 | 0.0 |
| Secondary Th2 act | 0.0 | 0.0 | HUVEC IFN gamma | 0.0 | 0.0 |
| Secondary Tr1 act | 0.0 | 0.0 | HUVEC TNF alpha + IFN gamma | 0.0 | 0.0 |
| Secondary Th1 rest | 0.2 | 0.0 | HUVEC TNF alpha + IL4 | 0.0 | 0.0 |
| Secondary Th2 rest | 0.0 | 0.0 | HUVEC IL-11 | 0.0 | 0.0 |
| Secondary Tr1 rest | 0.2 | 0.0 | Lung Microvascular EC none | 0.0 | 0.0 |
| Primary Th1 act | 0.0 | 0.0 | Lung Microvascular EC TNFalpha + IL-1beta | 0.0 | 0.0 |

TABLE 25F-continued

Panel 4D

| Tissue Name | Rel. Exp. (%) Ag2044, Run 150925280 | Rel. Exp. (%) Ag2044, Run 151536254 | Tissue Name | Rel. Exp. (%) Ag2044, Run 150925280 | Rel. Exp. (%) Ag2044, Run 151536254 |
|---|---|---|---|---|---|
| Primary Th2 act | 0.0 | 0.0 | Microvascular Dermal EC none | 0.0 | 0.0 |
| Primary Tr1 act | 0.0 | 0.0 | Microsvasular Dermal EC TNFalpha + IL-1beta | 0.0 | 0.0 |
| Primary Th1 rest | 0.0 | 0.0 | Bronchial epithelium TNFalpha + IL 1beta | 0.6 | 6.3 |
| Primary Th2 rest | 0.0 | 0.0 | Small airway epithelium none | 0.3 | 1.6 |
| Primary Tr1 rest | 0.3 | 0.0 | Small airway epithelium TNFalpha + IL-1beta | 0.6 | 2.3 |
| CD45RA CD4 lymphocyte act | 0.0 | 0.0 | Coronery artery SMC rest | 0.0 | 0.7 |
| CD45RO CD4 lymphocyte act | 0.0 | 0.0 | Coronery artery SMC TNFalpha + IL-1beta | 0.0 | 0.0 |
| CD8 lymphocyte act | 0.0 | 0.0 | Astrocytes rest | 0.2 | 0.4 |
| Secondary CD8 lymphocyte rest | 0.0 | 0.0 | Astrocytes TNFalpha + IL-1beta | 100.0 | 3.2 |
| Secondary CD8 lymphocyte act | 0.0 | 0.0 | KU-812 (Basophil) rest | 0.0 | 0.0 |
| CD4 lymphocyte none | 0.2 | 0.0 | KU-812 (Basophil) PMA/ionomycin | 0.0 | 0.0 |
| 2ry Th1/Th2/Tr1_anti-CD95 CH11 | 0.0 | 0.0 | CCD1106 (Keratinocytes) none | 0.1 | 1.2 |
| LAK cells rest | 0.0 | 0.0 | CCD1106 (Keratinocytes) TNFalpha + IL-1beta | 0.0 | 0.7 |
| LAK cells IL-2 | 0.0 | 0.0 | Liver cirrhosis | 1.4 | 5.8 |
| LAK cells IL-2 + IL-12 | 0.0 | 0.0 | Lupus kidney | 0.0 | 0.4 |
| LAK cells IL-2 + IFN gamma | 0.0 | 0.0 | NCI-H292 none | 24.7 | 75.3 |
| LAK cells IL-2 + IL-18 | 0.0 | 0.0 | NCI-H292 IL-4 | 32.5 | 95.3 |
| LAK cells PMA/ionomycin | 0.1 | 0.0 | NCI-H292 IL-9 | 24.8 | 85.3 |
| NK Cells IL-2 rest | 0.0 | 0.0 | NCI-H292 IL-13 | 24.1 | 100.0 |
| Two Way MLR 3 day | 0.0 | 0.0 | NCI-H292 IFN gamma | 22.5 | 75.8 |
| Two Way MLR 5 day | 0.0 | 0.0 | HPAEC none | 0.0 | 0.0 |
| Two Way MLR 7 day | 0.0 | 0.0 | HPAEC TNF alpha + IL-1 beta | 0.0 | 0.0 |
| PBMC rest | 0.0 | 0.0 | Lung fibroblast none | 0.0 | 0.0 |
| PBMC PWM | 0.0 | 0.0 | Lung fibroblast TNF alpha + IL-1 beta | 0.0 | 0.0 |
| PBMC PHA-L | 0.0 | 0.0 | Lung fibroblast IL-4 | 0.0 | 0.0 |
| Ramos (B cell) none | 0.0 | 0.0 | Lung fibroblast IL-9 | 0.0 | 0.0 |
| Ramos (B cell) ionomycin | 0.0 | 0.0 | Lung fibroblast IL-13 | 0.0 | 0.0 |
| B lymphocytes PWM | 0.0 | 0.0 | Lung fibroblast IFN gamma | 0.0 | 0.0 |
| B lymphocytes CD40L and IL-4 | 0.0 | 0.0 | Dermal fibroblast CCD1070 rest | 0.0 | 0.4 |
| EOL-1 dbcAMP | 0.0 | 0.0 | Dermal fibroblast CCD1070 TNF alpha | 0.0 | 0.0 |
| EOL-1 dbcAMP PMA/ionomycin | 0.0 | 0.0 | Dermal fibroblast CCD1070 IL-1 beta | 0.0 | 0.0 |
| Dendritic cells none | 0.0 | 0.0 | Dermal fibroblast IFN gamma | 0.0 | 0.0 |
| Dendritic cells LPS | 0.0 | 0.0 | Dermal fibroblast IL-4 | 0.0 | 0.0 |
| Dendritic cells anti-CD40 | 0.0 | 0.0 | IBD Colitis 2 | 0.0 | 0.0 |
| Monocytes rest | 0.0 | 0.0 | IBD Crohn's | 0.0 | 0.0 |
| Monocytes LPS | 0.1 | 0.4 | Colon | 4.5 | 11.0 |
| Marcophages rest | 0.0 | 0.0 | Lung | 23.3 | 84.7 |
| Macrophages LPS | 0.0 | 0.0 | Thymus | 0.7 | 2.6 |
| HUVEC none | 0.0 | 0.0 | Kidney | 0.2 | 1.3 |
| HUVEC starved | 0.0 | 0.0 | | | |

General_screening_panel_v1.4 Summary: Ag2044 The expression of the CG54933-01 gene appears to be highest in a sample derived from a gastric cancer cell line (NCI-N87) (CT=25.1). In addition, there is substantial expression in ovarian cancer cell lines, a pancreatic cancer cell line and colon cancer cell lines. Thus, the expression of this gene could be used to distinguish NCI-N87 cells from the rest of the samples in the panel. Moreover, therapeutic modulation of this gene, through the use of small molecule drugs, monoclonal antibodies or protein therapeutics might be beneficial for the treatment of colon cancer, gastric cancer, pancreatic cancer or ovarian cancer.

The expression of the isoform of this gene in endocrine/metabolically-related tissues is restricted to adipose, pancreas and small intestine. Due to its presumed role in cell adhesion and the moderate level of expression in adipose, this gene and/or gene product may be a target in the treatment of obesity.

Panel 1.3D Summary: Ag2044 The expression of the CG54933-01 gene was assessed in two independent runs on panel 1.3D with excellent concordance between the runs. The expression of this gene is highest in a sample derived from a gastric cancer cell line (NCI-N87) (CTs=28), consistent with the expression in General_screening_panel_v1.4. In addition, there is substantial expression observed in colon cancer cell lines, ovarian cancer cell lines, normal lung tissue, a liver cancer sample and a sample derived from a pancreatic cancer cell line. Thus, the expression of this gene could be used to distinguish NCI-N87 cells from other samples in the panel. Moreover, therapeutic modulation of this gene, through the use of small molecule drugs, antibodies or protein therapeutics might be beneficial for the treatment of colon cancer, gastric cancer, pancreatic cancer, liver cancer or ovarian cancer.

Panel 2D Summary: Ag2044 The expression of the CG54933-01 gene was assessed in two independent runs on panel 2D with excellent concordance between the runs. Overall, the expression of this gene is highest in samples derived from ovarian cancer tissue (CTs=25). This gene encodes a protein that is homologous to mesothelin, which has been shown to be up-regulated in ovarian cancer. In addition, there is substantial expression observed in metastatic colon cancer derived tissue, lung derived tissue and gastric cancer derived tissue. Thus, the expression of this gene could be used to distinguish the above mentioned tissues from other samples in the panel. Moreover, therapeutic modulation of this gene, through the use of small molecule drugs, antibodies or protein therapeutics might be beneficial for the treatment of colon cancer, gastric cancer, lung cancer or ovarian cancer.

References:

Hassan R, Viner J L, Wang Q C, Margulies I, Kreitman R J, Pastan I. Anti-tumor activity of K1-LysPE38QQR, an immunotoxin targeting mesothelin, a cell-surface antigen overexpressed in ovarian cancer and malignant mesothelioma.

J Immunother 2000 July–August;23(4):473–9

Mesothelin, a differentiation antigen, is a 40-kD glycosylphosphatidylinositol-linked cell-surface glycoprotein, that is present on the surface of normal mesothelium and is overexpressed in many patients with epithelial ovarian cancer and malignant mesotheliomas. Monoclonal antibody K1 is a murine immunoglobulin GI that recognizes mesothelin. LysPE38QQR is a truncated form of Pseudomonas exotoxin that lacks the cell-binding domain, but retains the translocation and adenosine diphosphate-ribosylation domains. It has a single lysine residue near the amino terminus that is available for conjugation to antibodies. To prevent chemical conjugation of the antibody to lysine residues at the C-terminus of Pseudomonas exotoxin, the two lysine residues at positions 590 and 606 were mutated to glutamine, and the lysine residue at position 613 was mutated to arginine. Monoclonal antibody K1 was chemically conjugated with LysPE38QQR, by modifying the antibody with sulfosuccinimidyl-4-(N-maleimidomethyl)cyclohexane-1-carboxylate and coupling it with SPDP N-succinimidyl 3-(2-pyridyldithio)propionate-modified LysPE38QQR. The resulting immunotoxin K1-LysPE38QQR was highly toxic to A431-K5 cells (a human epidermoid carcinoma cell line transfected with a mesothelin expression plasmid) with a half-maximal inhibitory concentration of 3–6 ng/mL. The immunotoxin had negligible activity against A431 cells, which do not express mesothelin (median inhibitory concentration>100 ng/mL). This immunotoxin also caused complete regression of tumors in nude mice that received xenografts of mesothelin-positive human carcinomas. These results show that immunotoxins directed against mesothelin are a therapeutic option that merits further investigation for the treatment of ovarian cancer and malignant mesotheliomas.

PMID: 10916757

Panel 3D Summary: Ag2044 The expression of the CG54933-01 gene appears to be highest in a sample derived from a lung cancer cell line (DMS-79)(CT=27.8). In addition, there appears to be substantial expression in colon cancer derived cell lines, pancreatic cancer derived cell lines, gastric cancer derived cell lines, lung cancer derived cell lines and cervical cancer derived cell lines. Thus, the expression of this gene could be used to distinguish DMS-79 cells from other samples in the panel. Moreover, therapeutic modulation of this gene, through the use of small molecule drugs, antibodies or protein therapeutics might be beneficial for the treatment of colon cancer, gastric cancer, lung cancer, cervical cancer, or pancreatic cancer.

Panel 4D Summary: Ag2044 The expression of the CG54933-01 gene was assessed in two independent runs using same set of primers. Both runs show moderate expression of this transcript in the NCI H292 cell line, a human airway epithelial cell line that produces mucins. Mucus overproduction is an important feature of bronchial asthma and chronic obstructive pulmonary disease (COPD). This transcript encodes for mesothelin, a cell surface protein, that may play a role in cellular adhesion or in megakaryocyte proliferation. Thus, this gene may be involved in promoting hyperplasia or mucus production in these cell type. Therefore, modulation of the expression or activity of this gene or gene product by antibodies could beneficial for the treatment of these asthma and COPD.

SEC8 (CG56010-01)

Expression of gene CG56010-01 was assessed using the primer-probe set Ag1438, described in Table 26A. Results of the RTQ-PCR runs are shown in Tables 26B, 26C, 26D, 26E and 26F.

TABLE 26A

Probe Name Ag1438

| Primers | Sequences | | Length | Start Position |
|---|---|---|---|---|
| Forward | 5'-gccaggcactgttcatctc-3' | (SEQ ID NO:162) | 19 | 285 |
| Probe | TET-5'-ctcccggcaagctttctgctgaaag-3'-TAMRA | (SEQ ID NO:163) | 25 | 322 |
| Reverse | 5'-gacatcaggctccagatatgaa-3' | (SEQ ID NO:164) | 22 | 347 |

TABLE 26B

Panel 1.2

| Tissue Name | Rel. Exp.(%) Ag1438, Run 138373879 | Tissue Name | Rel. Exp.(%) Ag1438, Run 138373879 |
|---|---|---|---|
| Endothelial cells | 0.1 | Renal ca. 786-0 | 0.0 |
| Heart (Fetal) | 1.0 | Renal ca. A498 | 0.0 |
| Pancreas | 0.2 | Renal ca. RXF 393 | 0.0 |
| Pancreatic ca. CAPAN 2 | 0.0 | Renal ca. ACHN | 0.0 |
| Adrenal Gland | 3.2 | Renal ca. UO-31 | 0.0 |
| Thyroid | 22.8 | Renal ca. TK-10 | 0.0 |
| Salivary gland | 16.7 | Liver | 0.4 |
| Pituitary gland | 0.1 | Liver (fetal) | 0.1 |
| Brain (fetal) | 0.0 | Liver ca. (hepatoblast) HepG2 | 0.5 |
| Brain (whole) | 0.0 | Lung | 0.1 |
| Brain (amygdala) | 0.0 | Lung (fetal) | 0.1 |
| Brain (cerebellum) | 0.0 | Lung ca. (small cell) LX-1 | 47.6 |
| Brain (hippocampus) | 0.0 | Lung ca. (small cell) NCI-H69 | 4.6 |
| Brain (thalamus) | 0.0 | Lung ca. (s.cell var.) SHP-77 | 7.2 |
| Cerebral Cortex | 0.0 | Lung ca. (large cell) NCI-H460 | 0.0 |
| Spinal cord | 0.0 | Lung ca. (non-sm. cell) A549 | 0.5 |
| glio/astro U87-MG | 0.0 | Lung ca. (non-s.cell) NCI-H23 | 0.0 |
| glio/astro U-118-MG | 0.0 | Lung ca. (non-s.cell) HOP-62 | 0.0 |
| astrocytoma SW1783 | 0.0 | Lung ca. (non-s.cl) NCI-H522 | 0.0 |
| neuro*; met SK-N-AS | 0.0 | Lung ca. (squam.) SW 900 | 0.1 |
| astrocytoma SF-539 | 0.0 | Lung ca. (squam.) NCI-H596 | 2.7 |
| astrocytoma SNB-75 | 0.0 | Mammary gland | 0.7 |
| glioma SNB-19 | 0.0 | Breast ca.* (pl.ef) MCF-7 | 1.4 |
| glioma U251 | 0.0 | Breast ca.* (pl.ef) MDA-MB-231 | 0.0 |
| glioma SF-295 | 0.0 | Breast ca.* (pl.ef) T47D | 100.0 |
| Heart | 1.6 | Breast ca. BT-549 | 0.0 |
| Skeletal Muscle | 0.4 | Breast ca. MDA-N | 0.0 |
| Bone marrow | 2.5 | Ovary | 1.1 |
| Thymus | 0.0 | Ovarian ca. OVCAR-3 | 0.0 |
| Spleen | 0.4 | Ovarian ca. OVCAR-4 | 0.0 |
| Lymph node | 0.0 | Ovarian ca. OVCAR-5 | 0.1 |
| Colorectal Tissue | 22.2 | Ovarian ca. OVCAR-8 | 0.0 |
| Stomach | 0.2 | Ovarian ca. IGROV-1 | 0.0 |
| Small intestine | 15.9 | Ovarian ca. (ascites) SK-OV-3 | 0.0 |
| Colon ca. SW480 | 0.0 | Uterus | 0.3 |
| Colon ca.* SW620 (SW480 met) | 4.1 | Placenta | 0.0 |
| Colon ca. HT29 | 1.7 | Prostate | 3.5 |
| Colon ca. HCT-116 | 0.0 | Prostate ca.* (bone met) PC-3 | 0.1 |
| Colon ca. CaCo-2 | 4.6 | Testis | 0.0 |
| Colon ca. Tissue (ODO3866) | 2.0 | Melanoma Hs688(A).T | 0.0 |
| Colon ca. HCC-2998 | 0.0 | Melanoma* (met) Hs688(B).T | 0.0 |
| Gastric ca.* (liver met) NCI-N87 | 0.0 | Melanoma UACC-62 | 0.0 |

TABLE 26B-continued

Panel 1.2

| Tissue Name | Rel. Exp.(%) Ag1438, Run 138373879 | Tissue Name | Rel. Exp.(%) Ag1438, Run 138373879 |
|---|---|---|---|
| Bladder | 3.6 | Melanoma M14 | 0.0 |
| Trachea | 4.9 | Melanoma LOX IMVI | 0.0 |
| Kidney | 0.7 | Melanoma* (met) SK-MEL-5 | 0.0 |
| Kidney (fetal) | 1.0 | | |

TABLE 26C

Panel 1.3D

| Tissue Name | Rel. Exp. (%) Ag1438, Run 146127639 | Rel. Exp. (%) Ag1438, Run 151268950 | Tissue Name | Rel. Exp. (%) Ag1438, Run 146127639 | Rel. Exp. (%) Ag1438, Run 151268950 |
|---|---|---|---|---|---|
| Liver adenocarcinoma | 0.0 | 0.0 | Kidney (fetal) | 0.6 | 1.7 |
| Pancreas | 1.0 | 1.6 | Renal ca. 786-0 | 0.1 | 0.0 |
| Pancreatic ca. CAPAN 2 | 0.0 | 0.0 | Renal ca. A498 | 0.0 | 0.0 |
| Adrenal gland | 1.6 | 1.5 | Renal ca. RXF 393 | 0.1 | 0.0 |
| Thyroid | 50.3 | 62.4 | Renal ca. ACHN | 0.0 | 0.0 |
| Salivary gland | 4.8 | 9.7 | Renal ca. UO-31 | 0.0 | 0.0 |
| Pituitary gland | 0.2 | 0.2 | Renal ca. TK-10 | 0.0 | 0.0 |
| Brain (fetal) | 0.0 | 0.0 | Liver | 0.4 | 0.6 |
| Brain (whole) | 0.0 | 0.0 | Liver (fetal) | 0.3 | 0.3 |
| Brain (amygdala) | 0.0 | 0.1 | Liver ca. (hepatoblast) HepG2 | 0.3 | 0.3 |
| Brain (cerebellum) | 0.1 | 0.1 | Lung | 3.1 | 4.2 |
| Brain (hippocampus) | 0.1 | 0.4 | Lung (fetal) | 3.4 | 4.1 |
| Brain (substantia nigra) | 0.4 | 0.3 | Lung ca. (small cell) LX-1 | 39.0 | 33.7 |
| Brain (thalamus) | 0.1 | 0.1 | Lung ca. (small cell) NCI-H69 | 11.6 | 14.6 |
| Cerebral Cortex | 0.1 | 0.1 | Lung ca. (s.cell var.) SHP-77 | 32.1 | 30.8 |
| Spinal cord | 0.3 | 0.4 | Lung ca. (large cell)NCI-H460 | 0.0 | 0.0 |
| glio/astro U87-MG | 0.0 | 0.0 | Lung ca. (non-sm. cell) A549 | 0.5 | 0.8 |
| glio/astro U-118-MG | 0.0 | 0.0 | Lung ca. (non-s.cell) NCI-H23 | 0.0 | 0.0 |
| astrocytoma SW1783 | 0.0 | 0.0 | Lung ca. (non-s cell) HOP-62 | 0.0 | 0.1 |
| neuro*; met SK-N-AS | 0.1 | 0.2 | Lung ca. (non-s cl) NCI-H522 | 0.1 | 0.0 |
| astrocytoma SF-539 | 0.0 | 0.0 | Lung ca. (squam.) SW 900 | 0.1 | 0.0 |
| astrocytoma SNB-75 | 0.2 | 0.1 | Lung ca. (squam.) NCI-H596 | 4.3 | 3.3 |
| glioma SNB-19 | 0.0 | 0.1 | Mammary gland | 13.3 | 11.6 |
| glioma U251 | 0.0 | 0.0 | Breast ca.* (pl.ef) MCF-7 | 2.7 | 2.2 |
| glioma SF-295 | 0.0 | 0.0 | Breast ca.* (pl.ef) MDA-MB-231 | 0.7 | 0.5 |
| Heart (fetal) | 3.0 | 4.7 | Breast ca.* (pl.ef) T47D | 100.0 | 100.0 |
| Heart | 0.4 | 0.2 | Breast ca. BT-549 | 0.0 | 0.1 |
| Skeletal muscle (fetal) | 1.0 | 2.1 | Breast ca. MDA-N | 0.0 | 0.0 |
| Skeletal muscle | 0.2 | 0.1 | Ovary | 0.6 | 1.1 |
| Bone marrow | 5.1 | 6.2 | Ovarian ca. OVCAR-3 | 0.0 | 0.0 |
| Thymus | 0.2 | 0.2 | Ovarian ca. OVCAR-4 | 0.0 | 0.0 |
| Spleen | 2.9 | 3.2 | Ovarian ca. OVCAR-5 | 0.1 | 0.1 |

TABLE 26C-continued

Panel 1.3D

| Tissue Name | Rel. Exp. (%) Ag1438, Run 146127639 | Rel. Exp. (%) Ag1438, Run 151268950 | Tissue Name | Rel. Exp. (%) Ag1438, Run 146127639 | Rel. Exp. (%) Ag1438, Run 151268950 |
|---|---|---|---|---|---|
| Lymph node | 1.6 | 1.3 | Ovarian ca. OVCAR-8 | 0.0 | 0.0 |
| Colorectal | 22.1 | 31.6 | Ovarian ca. IGROV-1 | 0.0 | 0.0 |
| Stomach | 2.3 | 2.0 | Ovarian ca.* (ascites) SK-OV-3 | 0.0 | 0.0 |
| Small intestine | 21.3 | 25.9 | Uterus | 1.1 | 0.8 |
| Colon ca. SW480 | 0.0 | 0.1 | Placenta | 0.2 | 0.0 |
| Colon ca.* SW620(SW480 met) | 1.7 | 1.4 | Prostate | 4.2 | 6.1 |
| Colon ca. HT29 | 1.4 | 2.0 | Prostate ca.* (bone met)PC-3 | 0.0 | 0.3 |
| Colon ca. HCT-116 | 0.0 | 0.0 | Testis | 0.2 | 0.2 |
| Colon ca. CaCo-2 | 6.2 | 6.8 | Melanoma Hs688(A).T | 0.1 | 0.0 |
| Colon ca. tissue(ODO3866) | 36.1 | 28.7 | Melanoma* (met) Hs688(B).T | 0.0 | 0.0 |
| Colon ca. HCC-2998 | 0.0 | 0.0 | Melanoma UACC-62 | 0.0 | 0.0 |
| Gastric ca.* (liver met) NCI-N87 | 0.0 | 0.0 | Melonoma M14 | 0.1 | 0.0 |
| Bladder | 1.4 | 1.8 | Melanoma LOX IMVI | 0.0 | 0.2 |
| Trachea | 68.3 | 56.3 | Melanoma* (met) SK-MEL-5 | 0.0 | 0.0 |
| Kidney | 0.2 | 0.1 | Adipose | 3.4 | 3.6 |

TABLE 26D

Panel 2D

| Tissue Name | Rel. Exp. (%) Ag1438, Run 145165485 | Rel. Exp. (%) Ag1438, Run 145375711 | Tissue Name | Rel. Exp. (%) Ag1438, Run 145165485 | Rel. Exp. (%) Ag1438, Run 145375711 |
|---|---|---|---|---|---|
| Normal Colon | 16.3 | 4.6 | Kidney Margin 8120608 | 0.1 | 0.1 |
| CC Well to Mod Diff (ODO3866) | 6.5 | 1.6 | Kidney Cancer 8120613 | 0.0 | 0.0 |
| CC Margin (ODO3866) | 27.0 | 6.5 | Kidney Margin 8120614 | 0.1 | 0.0 |
| CC Gr.2 rectosigmoid (ODO3868) | 16.4 | 7.7 | Kidney Cancer 9010320 | 0.1 | 0.0 |
| CC Margin (ODO3868) | 0.2 | 0.1 | Kidney Margin 9010321 | 0.0 | 0.0 |
| CC Mod Diff (ODO3920) | 8.2 | 5.1 | Normal Uterus | 0.1 | 0.0 |
| CC Margin (ODO3920) | 6.7 | 3.2 | Uterus Cancer 064011 | 11.0 | 17.4 |
| CC Gr.2 ascend colon (ODO3921) | 27.9 | 16.0 | Normal Thyroid | 17.6 | 18.3 |
| CC Margin (ODO3921) | 14.8 | 6.0 | Thyroid Cancer 064010 | 0.0 | 0.0 |
| CC from Partial Hepatectomy (ODO4309) Mets | 5.6 | 3.9 | Thyroid Cancer A302152 | 0.1 | 0.1 |
| Liver Margin (ODO4309) | 0.1 | 0.0 | Thyroid Margin A302153 | 36.9 | 41.8 |
| Colon mets to lung (OD04451-01) | 7.2 | 5.7 | Normal Breast | 0.9 | 0.5 |
| Lung Margin (OD04451-02) | 0.4 | 0.1 | Breast Cancer (OD04566) | 1.1 | 1.1 |
| Normal Prostate 6546-1 | 1.5 | 1.0 | Breast Cancer (OD04590-01) | 3.5 | 1.0 |
| Prostate Cancer (OD04410) | 3.7 | 1.9 | Breast Cancer Mets (OD04590-03) | 13.0 | 12.9 |

TABLE 26D-continued

Panel 2D

| Tissue Name | Rel. Exp. (%) Ag1438, Run 145165485 | Rel. Exp. (%) Ag1438, Run 145375711 | Tissue Name | Rel. Exp. (%) Ag1438, Run 145165485 | Rel. Exp. (%) Ag1438, Run 145375711 |
|---|---|---|---|---|---|
| Prostate Margin (OD04410) | 5.8 | 5.4 | Breast Cancer Metastasis (OD04655-05) | 3.1 | 3.0 |
| Prostate Cancer (OD04720-01) | 0.1 | 0.2 | Breast Cancer 064006 | 2.9 | 1.9 |
| Prostate Margin (OD04720-02) | 0.6 | 1.0 | Breast Cancer 1024 | 11.4 | 3.5 |
| Normal Lung 061010 | 2.5 | 2.8 | Breast Cancer 9100266 | 27.7 | 33.4 |
| Lung Met to Muscle (ODO4286) | 0.0 | 0.0 | Breast Margin 9100265 | 3.5 | 7.1 |
| Muscle Margin (ODO4286) | 0.1 | 0.0 | Breast Cancer A209073 | 2.9 | 4.2 |
| Lung Malignant Cancer (OD03126) | 100.0 | 100.0 | Breast Margin A2090734 | 1.6 | 0.5 |
| Lung Margin (OD03126) | 0.6 | 0.5 | Normal Liver | 0.0 | 0.0 |
| Lung Cancer (OD04404) | 0.1 | 0.1 | Liver Cancer 064003 | 0.1 | 0.0 |
| Lung Margin (OD04404) | 0.7 | 0.1 | Liver Cancer 1025 | 0.0 | 0.0 |
| Lung Cancer (OD04565) | 0.0 | 0.0 | Liver Cancer 1026 | 0.1 | 0.0 |
| Lung Margin (OD04565) | 0.2 | 0.2 | Liver Cancer 6004-T | 0.0 | 0.0 |
| Lung Cancer (OD04237-01) | 1.9 | 1.0 | Liver Tissue 6004-N | 0.1 | 0.0 |
| Lung Margin (OD04237-02) | 0.4 | 0.1 | Liver Cancer 6005-T | 0.1 | 0.1 |
| Ocular Mel Met to Liver (ODO4310) | 0.0 | 0.0 | Liver Tissue 6005-N | 0.0 | 0.0 |
| Liver Margin (ODO4310) | 0.3 | 0.3 | Normal Bladder | 0.4 | 0.4 |
| Melanoma Mets to Lung (OD04321) | 0.4 | 0.3 | Bladder Cancer 1023 | 12.3 | 7.2 |
| Lung Margin (OD04321) | 0.3 | 0.3 | Bladder Cancer A302173 | 0.1 | 0.0 |
| Normal Kidney | 0.1 | 0.0 | Bladder Cancer (OD04718-01) | 0.0 | 0.0 |
| Kidney Ca, Nuclear grade 2 (OD04338) | 0.0 | 0.0 | Bladder Normal Adjacent (OD04718-03) | 0.0 | 0.0 |
| Kidney Margin (OD04338) | 0.1 | 0.0 | Normal Ovary | 0.2 | 0.1 |
| Kidney Ca Nuclear grade 1/2 (OD04339) | 0.0 | 0.0 | Ovarian Cancer 064008 | 0.1 | 0.0 |
| Kidney Margin (OD04339) | 0.1 | 0.0 | Ovarian Cancer (OD04768-07) | 0.1 | 0.1 |
| Kidney Ca, Clear cell type (OD04340) | 0.1 | 0.1 | Ovary Margin (OD04768-08) | 0.2 | 0.1 |
| Kidney Margin (OD04340) | 0.1 | 0.0 | Normal Stomach | 0.1 | 0.1 |
| Kidney Ca, Nuclear grade 3 (OD04348) | 0.0 | 0.0 | Gastric Cancer 9060358 | 0.2 | 0.1 |
| Kidney Margin (OD04348) | 0.1 | 0.1 | Stomach Margin 9060359 | 0.2 | 0.1 |
| Kidney Cancer (OD04622-01) | 0.1 | 0.1 | Gastric Cancer 9060395 | 1.3 | 0.5 |
| Kidney Margin (OD04622-03) | 0.1 | 0.1 | Stomach Margin 9060394 | 1.6 | 1.0 |
| Kidney Cancer (OD04450-01) | 0.0 | 0.0 | Gastric Cancer 9060397 | 15.2 | 9.2 |
| Kidney Margin (OD04450-03) | 0.1 | 0.0 | Stomach Margin 9060396 | 1.2 | 0.5 |
| Kidney Cancer 8120607 | 0.0 | 0.0 | Gastric Cancer 064005 | 1.7 | 1.1 |

TABLE 26E

Panel 3D

| Tissue Name | Rel. Exp.(%) Ag1438, Run 164169778 | Tissue Name | Rel. Exp.(%) Ag1438, Run 164169778 |
|---|---|---|---|
| Daoy- Medulloblastoma | 0.1 | Ca Ski- Cervical epidermoid carcinoma (metastasis) | 0.0 |
| TE671- Medulloblastoma | 0.4 | ES-2- Ovarian clear cell carcinoma | 0.0 |
| D283 Med- Medulloblastoma | 0.0 | Ramos- Stimulated with PMA/ionomycin 6 h | 0.0 |
| PFSK-1- Primitive Neuroectodermal | 0.4 | Ramos- Stimulated with PMA/ionomycin 14 h | 0.0 |
| XF-498- CNS | 1.3 | MEG-01- Chronic myelogenous leukemia (megokaryoblast) | 0.0 |
| SNB-78- Glioma | 0.0 | Raji- Burkitt's lymphoma | 0.0 |
| SF-268- Glioblastoma | 0.0 | Daudi- Burkitt's lymphoma | 0.0 |
| T98G- Glioblastoma | 0.0 | U266- B-cell plasmacytoma | 0.0 |
| SK-N-SH- Neuroblastoma (metastasis) | 0.0 | CA46- Burkitt's lymphoma | 0.0 |
| SF-295- Glioblastoma | 0.0 | RL- non-Hodgkin's B-cell lymphoma | 0.0 |
| Cerebellum | 0.1 | JM1- pre-B-cell lymphoma | 0.6 |
| Cerebellum | 0.0 | Jurkat- T cell leukemia | 0.0 |
| NCI-H292- Mucoepidermoid lung carcinoma | 0.0 | TF-1- Erythroleukemia | 0.0 |
| DMS-114- Small cell lung cancer | 0.0 | HUT 78- T-cell lymphoma | 0.0 |
| DMS-79- Small cell lung cancer | 17.6 | U937- Histiocytic lymphoma | 0.0 |
| NCI-H146- Small cell lung cancer | 65.1 | KU-812- Myelogenous leukemia | 0.0 |
| NCI-H526- Small cell lung cancer | 79.6 | 769-P- Clear cell renal carcinoma | 0.0 |
| NCI-N417- Small cell lung cancer | 0.0 | Caki-2- Clear cell renal carcinoma | 0.0 |
| NCI-H82- Small cell lung cancer | 0.1 | SW 839- Clear cell renal carcinoma | 0.0 |
| NCI-H157- Squamous cell lung cancer (metastasis) | 0.0 | G401- Wilms' tumor | 0.0 |
| NCI-H1155- Large cell lung cancer | 26.1 | Hs766T- Pancreatic carcinoma (LN metastasis) | 0.6 |
| NCI-H1299- Large cell lung cancer | 0.0 | CAPAN-1- Pancreatic adenocarcinoma (liver metastasis) | 0.8 |
| NCI-H727- Lung carcinoid | 88.3 | SU86.86- Pancreatic carcinoma (liver metastasis) | 0.7 |
| NCI-UMC-11- Lung carcinoid | 100.0 | BxPC-3- Pancreatic adenocarcinoma | 0.2 |
| LX-1- Small cell lung cancer | 21.2 | HPAC- Pancreatic adenocarcinoma | 0.0 |
| Colo-205- Colon cancer | 33.7 | MIA PaCa-2- Pancreatic carcinoma | 0.0 |
| KM12- Colon cancer | 18.2 | CFPAC-1- Pancreatic ductal adenocarcinoma | 0.0 |
| KM20L2- Colon cancer | 0.1 | PANC-1- Pancreatic epithelioid ductal carcinoma | 0.1 |
| NCI-H716- Colon cancer | 69.3 | T24- Bladder carcinoma (transitional cell) | 0.4 |
| SW-48- Colon adenocarcinoma | 43.2 | 5637- Bladder carcinoma | 0.0 |
| SW1116- Colon adenocarcinoma | 0.0 | HT-1197- Bladder carcinoma | 0.0 |
| LS 174T- Colon adenocarcinoma | 0.5 | UM-UC-3- Bladder carcinoma (transitional cell) | 0.0 |
| SW-948- Colon adenocarcinoma | 6.8 | A204- Rhabdomyosarcoma | 0.0 |
| SW-480- Colon adenocarcinoma | 3.7 | HT-1080- Fibrosarcoma | 0.0 |
| NCI-SNU-5- Gastric carcinoma | 0.0 | MG-63- Osteosarcoma | 0.0 |
| KATO III- Gastric carcinoma | 0.0 | SK-LMS-1- Leiomyosarcoma (vulva) | 0.0 |
| NCI-SNU- 16- Gastric carcinoma | 0.0 | SJRH30- Rhabdomyosarcoma (met to bone marrow) | 1.2 |
| NCI-SNU-1- Gastric carcinoma | 15.4 | A431- Epidermoid carcinoma | 0.0 |
| RF-1- Gastric adenocarcinoma | 0.0 | WM266-4- Melanoma | 0.0 |
| RF-48- Gastric adenocarcinoma | 0.0 | DU 145- Prostate carcinoma (brain metastasis) | 0.0 |

TABLE 26E-continued

Panel 3D

| Tissue Name | Rel. Exp.(%) Ag1438, Run 164169778 | Tissue Name | Rel. Exp.(%) Ag1438, Run 164169778 |
|---|---|---|---|
| MKN-45- Gastric carcinoma | 6.5 | MDA-MB-468- Breast adenocarcinoma | 0.0 |
| NCI-N87- Gastric carcinoma | 0.0 | SCC-4- Squamous cell carcinoma of tongue | 0.0 |
| OVCAR-5- Ovarian carcinoma | 0.0 | SCC-9- Squamous cell carcinoma of tongue | 0.0 |
| RL95-2- Ulterine carcinoma | 0.0 | SCC-15- Squamous cell carcinoma of tongue | 0.0 |
| HelaS3- Cervical adenocarcinoma | 0.0 | CAL 27- Squamous cell carcinoma of tongue | 0.0 |

TABLE 26F

Panel 4D

| Tissue Name | Rel. Exp.(%) Ag1438, Run 164183835 | Tissue Name | Rel. Exp.(%) Ag1438, Run 164183835 |
|---|---|---|---|
| Secondary Th1 act | 0.0 | HUVEC IL-1 beta | 0.1 |
| Secondary Th2 act | 0.0 | HUVEC IFN gamma | 0.5 |
| Secondary Tr1 act | 0.0 | HUVEC TNF alpha + IFN gamma | 0.3 |
| Secondary Th1 rest | 0.0 | HUVEC TNF alpha + IL4 | 0.1 |
| Secondary Th2 rest | 0.0 | HUVEC IL-11 | 0.2 |
| Secondary Tr1 rest | 0.0 | Lung Microvascular EC none | 8.3 |
| Primary Th1 act | 0.0 | Lung Microvascular EC TNFalpha + IL-1 beta | 6.1 |
| Primary Th2 act | 0.1 | Microvascular Dermal EC none | 11.9 |
| Primary Tr1 act | 0.0 | Microvasular Dermal EC TNFalpha + IL-1 beta | 6.2 |
| Primary Th1 rest | 0.0 | Bronchial epithelium TNFalpha + IL1 beta | 0.6 |
| Primary Th2 rest | 0.0 | Small airway epithelium none | 0.6 |
| Primary Tr1 rest | 0.0 | Small airway epithelium TNFalpha + IL-1 beta | 2.9 |
| CD45RA CD4 lymphocyte act | 0.0 | Coronery artery SMC rest | 0.1 |
| CD45RO CD4 lymphocyte act | 0.0 | Coronery artery SMC TNFalpha + IL-1 beta | 0.0 |
| CD8 lymphocyte act | 0.0 | Astrocytes rest | 0.0 |
| Secondary CD8 lymphocyte rest | 0.0 | Astrocytes TNFalpha + IL-1 beta | 0.0 |
| Secondary CD8 lymphocyte act | 0.0 | KU-812 (Basophil) rest | 0.0 |
| CD4 lymphocyte none | 0.1 | KU-812 (Basophil) PMA/ionomycin | 0.0 |
| 2ry Th1/Th2/Tr1_anti-CD95 CH1 1 | 0.0 | CCD1106 (Keratinocytes) none | 0.0 |
| LAK cells rest | 0.1 | CCD1106 (Keratinocytes) TNFalpha + IL-1 beta | 0.0 |
| LAK cells IL-2 | 0.0 | Liver cirrhosis | 2.1 |
| LAK cells IL-2 + IL-12 | 0.0 | Lupus kidney | 0.2 |
| LAK cells IL-2 + IFN gamma | 0.0 | NCI-H292 none | 0.0 |
| LAK cells IL-2 + IL-18 | 0.0 | NCI-H292 IL-4 | 0.0 |
| LAK cells PMA/ionomycin | 0.0 | NCI-H292 IL-9 | 0.0 |
| NK Cells IL-2 rest | 0.0 | NCI-H292 IL-13 | 0.0 |
| Two Way MLR 3 day | 0.0 | NCI-H292 IFN gamma | 0.0 |
| Two Way MLR 5 day | 0.0 | HPAEC none | 0.0 |
| Two Way MLR 7 day | 0.0 | HPAEC TNF alpha + IL-1 beta | 0.1 |
| PBMC rest | 0.0 | Lung fibroblast none | 0.0 |
| PBMC PWM | 0.0 | Lung fibroblast TNF alpha + IL-1 beta | 0.0 |
| PBMC PHA-L | 0.0 | Lung fibroblast IL-4 | 0.1 |
| Ramos (B cell) none | 0.0 | Lung fibroblast IL-9 | 0.0 |
| Ramos (B cell) ionomycin | 0.0 | Lung fibroblast IL-13 | 0.0 |
| B lymphocytes PWM | 0.0 | Lung fibroblast IFN gamma | 0.0 |
| B lymphocytes CD40L and IL-4 | 0.0 | Dermal fibroblast CCD1070 rest | 0.0 |

TABLE 26F-continued

Panel 4D

| Tissue Name | Rel. Exp.(%) Ag1438, Run 164183835 | Tissue Name | Rel. Exp.(%) Ag1438, Run 164183835 |
|---|---|---|---|
| EOL-1 dbcAMP | 0.0 | Dermal fibroblast CCD1070 TNF alpha | 0.0 |
| EOL-1 dbcAMP PMA/ionomycin | 0.0 | Dermal fibroblast CCD1070 IL-1 beta | 0.0 |
| Dendritic cells none | 0.0 | Dermal fibroblast IFN gamma | 0.0 |
| Dendritic cells LPS | 0.0 | Dermal fibroblast IL-4 | 1.2 |
| Dendritic cells anti-CD40 | 0.0 | IBD Colitis 2 | 0.4 |
| Monocytes rest | 0.0 | IBD Crohn's | 2.1 |
| Monocytes LPS | 0.0 | Colon | 100.0 |
| Macrophages rest | 0.0 | Lung | 1.9 |
| Macrophages LPS | 0.0 | Thymus | 0.4 |
| HUVEC none | 0.2 | Kidney | 0.5 |
| HUVEC starved | 0.8 | | |

Panel 1.2 Summary: Ag1438 Highest expression of the CG56010-01 gene is seen in breast cancer (CT=20.1), with significant expression also seen in a cluster of lung cancer cell lines. Thus, expression of this gene could be used to differentiate between these samples and other samples on this panel. Furthermore, therapeutic modulation of the expression or function of this gene product through the application of small molecules or monoclonal antibodies may be effective in the treatment of breast and lung cancers.

Panel 1.3D Summary: Ag1438 Two experiments with the same probe and primer set produce results that are in excellent agreement, with highest expression of the CG56010-01 gene in a breast cancer cell line (CTs=27). Significant expression is also seen in a cluster of lung and colon cancer cell lines. This expression is consistent with the expression in Panel 1.2. Thus, expression of this gene could be used to differentiate between these samples and other samples on this panel. Furthermore, therapeutic modulation of the expression or function of this gene product through the application of small molecules or monoclonal antibodies may be effective in the treatment of breast, colon and lung cancers.

There is also moderate expression of this gene in several endocrine/metabolic related tissues, including adrenal, adipose, GI tract, pancreas and thyroid. Therefore, therapeutic modulation of this gene and/or gene-product may be useful in the treatment of diseases that involve the above mentioned tissues.

Panel 2D Summary: Ag1438 Two experiments with the same probe and primer set produce results that are in excellent agreement, with highest expression of the CG56010-01 gene in a lung cancer cell line (CTs=22–24). Significant expression is also seen in samples derived from breast, gastric, bladder, and uterine cancers. Thus, expression of this gene could be used to differentiate between these samples and other samples on this panel. Furthermore, therapeutic targeting of this gene product with a monoclonal antibody is anticipated to limit or block the extent of tumor growth in Subsets of breast cancers, gastric carcinomas, uterian tumors, transitional cell carcinomas of the bladder and lung adenocarcinomas/squamous cell carcinomas. Based on this gene's homology to trefoil 3, restricted normal tissue distribution, and preferential expression in proliferative cell lines seen in the previous panels, this gene product provides an excellent opportunity for drug targeting.

References:

Taupin D, Pedersen J, Familari M, Cook G, Yeomans N, Giraud A S. Augmented intestinal trefoil factor (TFF3) and loss of pS2 (TFF1) expression precedes metaplastic differentiation of gastric epithelium. Lab Invest 2001 March;81(3):397–408

The trefoil peptides spasmolytic polypeptide (SP), intestinal trefoil factor (ITF), and pS2 show lineage-specific expression in the normal gut and are strongly induced after mucosal injury. We assessed the relationship between this induction and the development of the regenerative epithelial lineage over time in the rat stomach and verified these observations in the metaplastic and dysplastic human stomach. Antral or colonic ulcers were induced in Wistar rats by application of serosal acetic acid and tissues harvested 2 hours to 125 days later. Human endoscopic biopsies or gastric resection specimens were also assessed. Tissues were examined by radioimmunoassay, immunoblotting, or immunohistochemistry for ITF, SP, and transforming growth factor alpha (rat) or ITF and pS2 (human) expression. ITF and SP mRNA in antral ulcer margins was localized by in situ hybridization. ITF and SP peptide expression rose steadily in ulcer margins after 4 days, with the rise in ITF being more pronounced. By 40 days, several hundred-fold elevations in ITF levels were present, with a field effect in uninvolved mucosa. Hyperproliferative, elongated glands of undifferentiated cells expressing abundant trefoil peptides and acid sulfomucins were present after day 12 and persisted after ulcer healing. ITF mRNA was aberrantly expressed in basal and mid-regions of these regenerative glands. In contrast, transforming growth factor alpha peptide expression rose promptly after injury then fell to baseline levels with healing. Seven months after injury, gastric atrophy, intestinal metaplasia, and severe dysplasia with conserved ITF expression were seen. ITF was also induced in human intestinal metaplasia and conserved in all gastric cancers, whereas expression of the gastric peptide pS2 was progressively reduced in the progression from metaplasia to dysplasia. Persistent, selective overexpression of ITF, possibly acting in an autocrine fashion, is a feature of regeneration after antral ulceration, and may provide insight into the nature of metaplastic phenotypes arising from chronic gastric injury. The loss of pS2 expression in metaplasia and cancer supports a role for this protein in gastric tumor suppression.

PMID: 11310832

Efstathiou J A, Noda M, Rowan A, Dixon C, Chinery R, Jawhari A, Hattori T, Wright N A, Bodmer W F, Pignatelli M. Intestinal trefoil factor controls the expression of the adenomatous polyposis coli-catenin and the E-cadherin-catenin complexes in human colon carcinoma cells. Proc Natl Acad Sci USA Mar. 17, 1998;95(6):3122–7

Intestinal trefoil factor 3 (TFF3) is a member of the trefoil family of peptides, small molecules constitutively expressed in epithelial tissues, including the gastrointestinal tract. TFF3 has been shown to promote migration of intestinal epithelial cells in vitro and to enhance mucosal healing and epithelial restitution in vivo. In this study, we evaluated the effect of recombinant TFF3 (rTFF3) stimulation on the expression and cellular localization of the epithelial (E)-cadherin-catenin complex, a prime mediator of Ca2+ dependent cell-cell adhesion, and the adenomatous polyposis coli (APC)-catenin complex in HT29, HCT116, and SW480 colorectal carcinoma cell lines. Stimulation by rTFF3 (10(-9) M and 10(-8) M) for 20–24 hr led to cell detachment and to a reduction in intercellular adhesion in HT29 and HCT116 cells. In both cell lines, E-cadherin expression was down-regulated. The expression of APC, alpha-catenin and beta-catenin also was decreased in HT29 cells, with a translocation of APC into the nucleus. No change in either cell adhesion or in the expression of E-cadherin, the catenins, and APC was detected in SW480 cells. In addition, TFF3 induced DNA fragmentation and morphological changes characteristic of apoptosis in HT29. Tyrphostin, a competitive inhibitor of protein tyrosine kinases, inhibited the effects of TFF3. Our results indicate that by perturbing the complexes between E-cadherin, beta-catenin, and associated proteins, TFF3 may modulate epithelial cell adhesion, migration, and survival.

PMID: 9501226

Panel 3D Summary: Ag1438 Highest expression of the CG56010-01 gene is seen in a lung cancer cell line (CTs=26). Significant expression is also seen in a cluster of gastric and colon cancer cell lines. Thus, expression of this gene could be used to differentiate between these samples and other samples on this panel. Furthermore, therapeutic modulation of the expression or function of this gene product through the application of small molecules or monoclonal antibodies may be effective in the treatment of gastric, colon and lung cancers.

Panel 4D Summary: Ag1438 Highest expression of the CG56010-01 transcript is observed in colon (CT=28.1). This expression is expected considering the nature of the protein encoded by this transcript, the trefoil factor 3 (ref. 1). The expression of this transcript is down regulated in colon from patients suffering from either Crohn's or colitis, suggesting a role for this gene in the normal homeostasis of this tissue. Therefore, agonistic antibodies or protein therapeutics may be beneficial for the the restoration of the normal function of the colon mucosa in inflammatory diseases such as inflammatory bowel disease. Low expression of this transcript is also observed in the microvasculature of the lung and the dermis suggesting a role for this gene in the maintenance of the integrity of the microvasculature. Therefore, therapeutics designed for this putative protein could be beneficial for the treatment of diseases associated with damaged microvasculature including heart diseases or inflammatory diseases, such as psoriasis, asthma, and chronic obstructive pulmonary diseases.

References:

dos Santos Silva E, Ulrich M, Doring G, Botzenhart K, Gott P. Trefoil factor family domain peptides in the human respiratory tract.

Trefoil factor family domain peptides (TFF) are thought to be involved in mucosal epithelial restitution and wound healing of the gastrointestinal tract and are up-regulated in ulceration and in a variety of solid tumours. It was hypothesized that TFFs are also expressed on mucosal surfaces of the human respiratory tract. Lung tissue, nasal polyps, and sputum samples from seven patients with cystic fibrosis (CF), two with chronic and acute bronchitis, and non-dysplastic material from two cases of bronchial adenocarcinoma were analysed for TFF expression by immunohistochemistry, immunofluorescence, western blot and RT-PCR. Expression of TFF1 and TFF3 was observed in material from all patients. TFFs were localized in goblet and ciliated cells, as well as in some submucosal cells of tracheobronchial tissues and nasal polyps from normal and CF individuals. In sputa of patients with CF and with chronic or acute bronchitis, TFF1 and TFF3 were detected by western blotting. Freshly cultivated nasal epithelial cells transcribed and secreted TFFs and mucins, whereas nasal cells cultivated for 6 weeks still expressed mucins, but not TFFs. Secreted TFFs and mucins also bound to the surface of *Staphylococcus aureus* in infected CF airways. In conclusion, TFF1 and TFF3 are expressed and secreted in normal and inflamed airways. The association of TFFs with bacteria may contribute to the anti-microbial mucociliary defence system.

SEC3 (CG56015-01)

Expression of gene CG56015-01 was assessed using the primer-probe set Ag1360, described in Table 27A. Results of the RTQ-PCR runs are shown in Tables 27B, 27C, 27D, 27E and 27F.

TABLE 27A

| Probe Name Ag1360 | | | | |
|---|---|---|---|---|
| Primers | Sequences | | Length | Start Position |
| Forward | 5'-gagctcagaccgtgtctaggtt-3' | (SEQ ID NO:165) | 22 | 641 |
| Probe | TET-5'-cctggggtctcctgctcagctca-3'-TAMRA | (SEQ ID NO:166) | 23 | 679 |
| Reverse | 5'-gtcctctccagaaggctcttc-3' | (SEQ ID NO:167) | 21 | 702 |

TABLE 27B

| | Panel 1.2 | | | |
|---|---|---|---|---|
| Tissue Name | Rel. Exp.(%) Ag1360, Run 134774681 | Tissue Name | Rel. Exp.(%) Ag1360, Run 134774681 | |
| Endothelial cells | 0.1 | Renal ca. 786-0 | 14.0 | |
| Heart (Fetal) | 0.4 | Renal ca. A498 | 35.4 | |
| Pancreas | 2.3 | Renal ca. RXF 393 | 5.0 | |
| Pancreatic ca. CAPAN 2 | 0.3 | Renal ca. ACHN | 11.6 | |
| Adrenal Gland | 1.3 | Renal ca. UO-31 | 75.8 | |

TABLE 27B-continued

Panel 1.2

| Tissue Name | Rel. Exp.(%) Ag1360, Run 134774681 | Tissue Name | Rel. Exp.(%) Ag1360, Run 134774681 |
|---|---|---|---|
| Thyroid | 0.2 | Renal ca. TK-10 | 57.8 |
| Salivary gland | 32.8 | Liver | 1.4 |
| Pituitary gland | 0.2 | Liver (fetal) | 0.8 |
| Brain (fetal) | 0.0 | Liver ca. (hepatoblast) HepG2 | 0.2 |
| Brain (whole) | 0.0 | Lung | 3.8 |
| Brain (amygdala) | 0.0 | Lung (fetal) | 6.6 |
| Brain (cerebellum) | 0.0 | Lung ca. (small cell) LX-1 | 0.0 |
| Brain (hippocampus) | 0.0 | Lung ca. (small cell) NCI-H69 | 0.0 |
| Brain (thalamus) | 0.0 | Lung ca. (s.cell var.) SHP-77 | 0.0 |
| Cerebral Cortex | 0.1 | Lung ca. (large cell) NCI-H460 | 0.0 |
| Spinal cord | 0.1 | Lung ca. (non-sm. cell) A549 | 0.9 |
| glio/astro U87-MG | 0.0 | Lung ca. (non-s.cell) NCI-H23 | 0.0 |
| glio/astro U-118-MG | 0.0 | Lung ca. (non-s.cell) HOP-62 | 0.0 |
| astrocytoma SW1783 | 0.0 | Lung ca. (non-s.cl) NCI-H522 | 0.0 |
| neuro*; met SK-N-AS | 0.0 | Lung ca. (squam.) SW 900 | 20.2 |
| astrocytoma SF-539 | 0.0 | Lung ca. (squam.) NCI-H596 | 0.0 |
| astrocytoma SNB-75 | 0.0 | Mammary gland | 4.6 |
| glioma SNB-19 | 0.0 | Breast ca.* (pl.ef) MCF-7 | 0.0 |
| glioma U251 | 0.1 | Breast ca.* (pl.ef) MDA-MB-231 | 0.1 |
| glioma SF-295 | 0.1 | Breast ca.* (pl.ef) T47D | 0.1 |
| Heart | 0.3 | Breast ca. BT-549 | 0.0 |
| Skeletal Muscle | 0.1 | Breast ca. MDA-N | 0.0 |
| Bone marrow | 6.6 | Ovary | 0.2 |
| Thymus | 0.2 | Ovarian ca. OVCAR-3 | 0.0 |
| Spleen | 0.2 | Ovarian ca. OVCAR-4 | 2.2 |
| Lymph node | 0.0 | Ovarian ca. OVCAR-5 | 5.7 |
| Colorectal Tissue | 1.4 | Ovarian ca. OVCAR-8 | 0.9 |
| Stomach | 17.6 | Ovarian ca. IGROV-1 | 31.6 |
| Small intestine | 3.7 | Ovarian ca. (ascites) SK-OV-3 | 1.6 |
| Colon ca. SW480 | 0.0 | Uterus | 13.2 |
| Colon ca.* SW620 (SW480 met) | 0.0 | Placenta | 0.6 |
| Colon ca. HT29 | 2.9 | Prostate | 2.1 |
| Colon ca. HCT-116 | 0.0 | Prostate ca.* (bone met) PC-3 | 0.0 |
| Colon ca. CaCo-2 | 0.1 | Testis | 0.2 |
| Colon ca. Tissue (ODO3866) | 3.8 | Melanoma Hs688(A).T | 0.0 |
| Colon ca. HCC-2998 | 1.4 | Melanoma* (met) Hs688(B).T | 0.0 |
| Gastric ca.* (liver met) NCI-N87 | 1.7 | Melanoma UACC-62 | 0.0 |
| Bladder | 19.6 | Melanoma M14 | 0.0 |
| Trachea | 7.2 | Melanoma LOX IMVI | 0.0 |
| Kidney | 100.0 | Melanoma* (met) SK-MEL-5 | 0.0 |
| Kidney (fetal) | 21.0 | | |

TABLE 27C

Panel 1.3D

| Tissue Name | Rel. Exp.(%) Ag1360, Run 146124878 | Tissue Name | Rel. Exp.(%) Ag1360, Run 146124878 |
|---|---|---|---|
| Liver adenocarcinoma | 0.0 | Kidney (fetal) | 28.1 |
| Pancreas | 3.9 | Renal ca. 786-0 | 45.4 |
| Pancreatic ca. CAPAN 2 | 1.4 | Renal ca. A498 | 100.0 |
| Adrenal gland | 0.5 | Renal ca. RXF 393 | 12.8 |

TABLE 27C-continued

Panel 1.3D

| Tissue Name | Rel. Exp.(%) Ag1360, Run 146124878 | Tissue Name | Rel. Exp.(%) Ag1360, Run 146124878 |
|---|---|---|---|
| Thyroid | 0.2 | Renal ca. ACHN | 61.1 |
| Salivary gland | 16.7 | Renal ca. UO-31 | 25.5 |
| Pituitary gland | 0.1 | Renal ca. TK-10 | 72.2 |
| Brain (fetal) | 0.0 | Liver | 1.3 |
| Brain (whole) | 0.0 | Liver (fetal) | 1.1 |
| Brain (amygdala) | 0.1 | Liver ca. (hepatoblast) HepG2 | 0.3 |
| Brain (cerebellum) | 0.0 | Lung | 8.1 |
| Brain (hippocampus) | 0.0 | Lung (fetal) | 13.0 |
| Brain (substantia nigra) | 0.0 | Lung ca. (small cell) LX-1 | 0.0 |
| Brain (thalamus) | 0.1 | Lung ca. (small cell) NCI-H69 | 0.0 |
| Cerebral Cortex | 0.0 | Lung ca. (s.cell var.) SHP-77 | 0.0 |
| Spinal cord | 0.4 | Lung ca. (large cell) NCI-H460 | 0.0 |
| glio/astro U87-MG | 0.0 | Lung ca. (non-sm. cell) A549 | 0.4 |
| glio/astro U-118-MG | 0.0 | Lung ca. (non-s.cell) NCI-H23 | 0.0 |
| astrocytoma SW1783 | 0.0 | Lung ca. (non-s.cell) HOP-62 | 0.0 |
| neuro*; met SK-N-AS | 0.0 | Lung ca. (non-s.cl) NCI-H522 | 0.0 |
| astrocytoma SF-539 | 0.0 | Lung ca. (squam.) SW 900 | 17.6 |
| astrocytoma SNB-75 | 27.2 | Lung ca. (squam.) NCI-H596 | 0.0 |
| glioma SNB-19 | 0.0 | Mammary gland | 10.0 |
| glioma U251 | 0.1 | Breast ca.* (pl.ef) MCF-7 | 0.0 |
| glioma SF-295 | 0.8 | Breast ca.* (pl.ef) MDA-MB-231 | 0.7 |
| Heart (fetal) | 0.7 | Breast ca.* (pl.ef) T47D | 0.1 |
| Heart | 0.0 | Breast ca. BT-549 | 0.0 |
| Skeletal muscle (fetal) | 0.2 | Breast ca. MDA-N | 0.0 |
| Skeletal muscle | 0.0 | Ovary | 0.5 |
| Bone marrow | 9.0 | Ovarian ca. OVCAR-3 | 0.0 |
| Thymus | 0.2 | Ovarian ca. OVCAR-4 | 1.9 |
| Spleen | 0.3 | Ovarian ca. OVCAR-5 | 13.8 |
| Lymph node | 0.1 | Ovarian ca. OVCAR-8 | 0.5 |
| Colorectal | 5.2 | Ovrian ca. IGROV-1 | 36.6 |
| Stomach | 20.4 | Ovarian ca.* (ascites) SK-OV-3 | 3.1 |
| Small intestine | 3.2 | Uterus | 0.5 |
| Colon ca. SW480 | 0.0 | Placenta | 1.1 |
| Colon ca.* SW620(SW480 met) | 0.0 | Prostate | 1.2 |
| Colon ca. HT29 | 3.5 | Prostate ca.* (bone met)PC-3 | 1.2 |
| Colon ca. HCT-116 | 0.0 | Testis | 0.4 |
| Colon ca. CaCo-2 | 1.3 | Melanoma Hs688(A).T | 0.1 |
| Colon ca. tissue(ODO3866) | 34.6 | Melanoma* (met) Hs688(B).T | 0.0 |
| Colon ca. HCC-2998 | 3.5 | Melanoma UACC-62 | 0.0 |
| Gastric ca.* (liver met) NCI-N87 | 11.0 | Melanoma M14 | 0.0 |
| Bladder | 11.3 | Melanoma LOX IMVI | 0.0 |
| Trachea | 14.0 | Melanoma* (met) SK-MEL-5 | 0.0 |
| Kidney | 100.0 | Adipose | 2.4 |

TABLE 27D

Panel 2D

| Tissue Name | Rel. Exp. (%) Ag1360, Run 145081245 | Rel. Exp. (%) Ag1360, Run 145419838 | Tissue Name | Rel. Exp. (%) Ag1360, Run 145081245 | Rel. Exp. (%) Ag1360, Run 145419838 |
|---|---|---|---|---|---|
| Normal Colon | 0.6 | 0.3 | Kidney Margin 8120608 | 100.0 | 100.0 |

TABLE 27D-continued

Panel 2D

| Tissue Name | Rel. Exp. (%) Ag1360, Run 145081245 | Rel. Exp. (%) Ag1360, Run 145419838 | Tissue Name | Rel. Exp. (%) Ag1360, Run 145081245 | Rel. Exp. (%) Ag1360, Run 145419838 |
|---|---|---|---|---|---|
| CC Well to Mod Diff (ODO3866) | 2.1 | 0.9 | Kidney Cancer 8120613 | 0.1 | 0.0 |
| CC Margin (ODO3866) | 0.7 | 0.3 | Kidney Margin 8120614 | 80.1 | 10.9 |
| CC Gr.2 rectosigmoid (ODO3868) | 1.8 | 1.0 | Kidney Cancer 9010320 | 11.8 | 5.3 |
| CC Margin (ODO3868) | 0.1 | 0.0 | Kidney Margin 9010321 | 84.7 | 49.0 |
| CC Mod Diff (ODO3920) | 2.3 | 0.8 | Normal Uterus | 0.0 | 0.0 |
| CC Margin (ODO3920) | 0.4 | 0.1 | Uterus Cancer 064011 | 1.3 | 1.3 |
| CC Gr.2 ascend colon (ODO3921) | 2.8 | 0.7 | Normal Thyroid | 0.0 | 0.0 |
| CC Margin (ODO3921) | 0.6 | 0.1 | Thyroid Cancer 064010 | 2.2 | 1.1 |
| CC from Partial Hepatectomy (ODO4309) Mets | 6.3 | 0.3 | Thyroid Cancer A302152 | 2.9 | 1.9 |
| Liver Margin (ODO4309) | 0.0 | 0.0 | Thyroid Margin A302153 | 0.0 | 0.0 |
| Colon mets to lung (OD04451-01) | 1.7 | 0.8 | Normal Breast | 1.4 | 0.4 |
| Lung Margin (OD04451-02) | 0.7 | 0.2 | Breast Cancer (OD04566) | 0.0 | 0.1 |
| Normal Prostate 6546-1 | 0.3 | 0.3 | Breast Cancer (OD04590-01) | 0.1 | 0.0 |
| Prostate Cancer (OD04410) | 0.3 | 0.3 | Breast Cancer Mets (OD04590-03) | 0.0 | 0.0 |
| Prostate Margin (OD04410) | 0.3 | 0.4 | Breast Cancer Metastasis (OD04655-05) | 0.6 | 0.8 |
| Prostate Cancer (OD04720-01) | 0.3 | 0.4 | Breast Cancer 064006 | 1.6 | 1.4 |
| Prostate Margin (OD04720-02) | 1.3 | 0.9 | Breast Cancer 1024 | 2.0 | 0.9 |
| Normal Lung 061010 | 0.6 | 0.2 | Breast Cancer 9100266 | 1.3 | 1.1 |
| Lung Met to Muscle (ODO4286) | 0.0 | 0.0 | Breast Margin 9100265 | 0.5 | 0.4 |
| Muscle Margin (ODO4286) | 0.0 | 0.0 | Breast Cancer A209073 | 1.2 | 1.0 |
| Lung Malignant Cancer (OD03126) | 2.2 | 0.9 | Breast Margin A2090734 | 1.6 | 0.3 |
| Lung Margin (OD03126) | 1.4 | 0.4 | Normal Liver | 0.0 | 0.0 |
| Lung Cancer (OD04404) | 2.2 | 0.8 | Liver Cancer 064003 | 0.1 | 0.0 |
| Lung Margin (OD04404) | 1.1 | 0.4 | Liver Cancer 1025 | 0.0 | 0.0 |
| Lung Cancer (OD04565) | 0.5 | 0.7 | Liver Cancer 1026 | 0.1 | 0.0 |
| Lung Margin (OD04565) | 1.0 | 1.8 | Liver Cancer 6004-T | 0.1 | 0.0 |
| Lung Cancer (OD04237-01) | 0.5 | 0.2 | Liver Tissue 6004-N | 0.0 | 0.0 |
| Lung Margin (OD04237-02) | 1.4 | 0.2 | Liver Cancer 6005-T | 0.1 | 0.1 |
| Ocular Mel Met to Liver (ODO4310) | 0.0 | 0.0 | Liver Tissue 6005-N | 0.0 | 0.0 |
| Liver Margin (ODO4310) | 0.1 | 0.1 | Normal Bladder | 5.0 | 6.5 |
| Melanoma Mets to Lung (OD04321) | 0.0 | 0.0 | Bladder Cancer 1023 | 1.3 | 0.9 |
| Lung Margin (OD04321) | 1.4 | 0.5 | Bladder Cancer A302173 | 0.5 | 0.2 |
| Normal Kidney | 45.4 | 14.9 | Bladder Cancer (OD04718-01) | 1.9 | 1.8 |
| Kidney Ca, Nuclear grade 2 (OD04338) | 44.1 | 19.6 | Bladder Normal Adjacent (OD04718-03) | 0.0 | 0.0 |

TABLE 27D-continued

Panel 2D

| Tissue Name | Rel. Exp. (%) Ag1360, Run 145081245 | Rel. Exp. (%) Ag1360, Run 145419838 | Tissue Name | Rel. Exp. (%) Ag1360, Run 145081245 | Rel. Exp. (%) Ag1360, Run 145419838 |
|---|---|---|---|---|---|
| Kidney Margin (OD04338) | 8.0 | 3.4 | Normal Ovary | 0.1 | 0.0 |
| Kidney Ca Nuclear grade 1/2 (OD04339) | 5.4 | 3.4 | Ovarian Cancer 064008 | 4.1 | 2.3 |
| Kidney Margin (OD04339) | 83.5 | 99.3 | Ovarian Cancer (OD04768-07) | 20.7 | 13.5 |
| Kidney Ca, Clear cell type (OD04340) | 23.5 | 31.9 | Ovary Margin (OD04768-08) | 0.1 | 0.2 |
| Kidney Margin (OD04340) | 23.5 | 13.9 | Normal Stomach | 0.2 | 0.2 |
| Kidney Ca, Nuclear grade 3 (OD04348) | 0.3 | 0.2 | Gastric Cancer 9060358 | 0.3 | 0.1 |
| Kidney Margin (OD04348) | 11.8 | 11.3 | Stomach Margin 9060359 | 1.7 | 1.5 |
| Kidney Cancer (OD04622-01) | 16.6 | 18.2 | Gastric Cancer 9060395 | 3.0 | 1.5 |
| Kidney Margin (OD04622-03) | 7.0 | 6.4 | Stomach Margin 9060394 | 3.1 | 1.5 |
| Kidney Cancer (OD04450-01) | 36.3 | 25.9 | Gastric Cancer 9060397 | 4.6 | 3.4 |
| Kidney Margin (OD04450-03) | 14.1 | 6.6 | Stomach Margin 9060396 | 1.8 | 1.1 |
| Kidney Cancer 8120607 | 13.5 | 14.0 | Gastric Cancer 064005 | 1.7 | 1.0 |

TABLE 27E

Panel 3D

| Tissue Name | Rel. Exp.(%) Ag1360, Run 170745274 | Tissue Name | Rel. Exp.(%) Ag1360, Run 170745274 |
|---|---|---|---|
| Daoy- Medulloblastoma | 0.0 | Ca Ski- Cervical epidermoid carcinoma (metastasis) | 0.0 |
| TE671- Medulloblastoma | 0.0 | ES-2- Ovarian clear cell carcinoma | 0.0 |
| D283 Med- Medulloblastoma | 0.0 | Ramos- Stimulated with PMA/ionomycin 6 h | 0.0 |
| PFSK-1- Primitive Neuroectodermal | 0.0 | Ramos- Stimulated with PMA/ionomycin 14 h | 0.0 |
| XF-498- CNS | 0.0 | MEG-01- Chronic myelogenous leukemia (megakaryoblast) | 4.2 |
| SNB-78- Glioma | 0.8 | Raji- Burkitt's lymphoma | 0.0 |
| SF-268-Glioblastoma | 0.0 | Daudi- Burkitt's lymphoma | 0.0 |
| T98G- Glioblastoma | 0.0 | U266- B-cell plasmacytoma | 0.0 |
| SK-N-SH- Neuroblastoma (metastasis) | 0.0 | CA46- Burkitt's lymphoma | 0.0 |
| SF-295- Glioblastoma | 0.3 | RL- non-Hodgkin's B-cell lymphoma | 36.6 |
| Cerebellum | 0.0 | JM1- pre-B-cell lymphoma | 0.0 |
| Cerebellum | 0.2 | Jurkat- T cell leukemia | 1.4 |
| NCI-H292- Mucoepidermoid lung carcinoma | 8.4 | TF-1- Erythroleukemia | 5.6 |
| DMS-114- Small cell lung cancer | 0.0 | HUT 78- T-cell lymphoma | 0.0 |
| DMS-79- Small cell lung cancer | 0.0 | U937- Histiocytic lymphoma | 0.0 |
| NCI-H146- Small cell lung cancer | 0.0 | KU-812- Myelogenous leukemia | 20.6 |
| NCI-H526- Small cell lung cancer | 0.0 | 769-P- Clear cell renal carcinoma | 73.7 |
| NCI-N417- Small cell lung cancer | 0.1 | Caki-2- Clear cell renal carcinoma | 100.0 |
| NCI-H82- Small cell lung cancer | 0.0 | SW 839- Clear cell renal carcinoma | 29.9 |
| NCI-H157- Squamous cell lung cancer (metastasis) | 0.0 | G401- Wilms' tumor | 0.0 |
| NCI-H1155- Large cell lung cancer | 1.0 | Hs766T- Pancreatic carcinoma (LN metastasis) | 2.6 |

TABLE 27E-continued

Panel 3D

| Tissue Name | Rel. Exp.(%) Ag1360, Run 170745274 | Tissue Name | Rel. Exp.(%) Ag1360, Run 170745274 |
|---|---|---|---|
| NCI-H1299- Large cell lung cancer | 0.0 | CAPAN-1- Pancreatic adenocarcinoma (liver metastasis) | 16.6 |
| NCI-H727- Lung carcinoid | 0.0 | SU86.86- Pancreatic carcinoma (liver metastasis) | 2.0 |
| NCI-UMC-11- Lung carcinoid | 0.0 | BxPC-3- Pancreatic adenocarcinoma | 1.6 |
| LX-1- Small cell lung cancer | 0.0 | HPAC- Pancreatic adenocarcinoma | 1.5 |
| Colo-205- Colon cancer | 3.0 | MIA PaCa-2- Pancreatic carcinoma | 0.0 |
| KM12- Colon cancer | 0.0 | CFPAC-1- Pancreatic ductal adenocarcinoma | 8.2 |
| KW20L2- Colon cancer | 9.6 | PANC-1- Pancreatic epithelioid ductal carcinoma | 0.0 |
| NCI-H716- Colon cancer | 0.0 | T24- Bladder carcinoma (transitional cell) | 0.0 |
| SW-48- Colon adenocarcinoma | 26.2 | 5637- Bladder carcinoma | 6.9 |
| SW1116- Colon adenocarcinoma | 0.0 | HT-1197- Bladder carcinoma | 0.0 |
| LS 174T- Colon adenocarcinoma | 23.0 | UM-UC-3- Bladder carcinoma (transitional cell) | 0.0 |
| SW-948- Colon adenocarcinoma | 1.4 | A204- Rhabdomyosarcoma | 1.3 |
| SW-480- Colon adenocarcinoma | 6.7 | HT-1080- Fibrosarcoma | 0.0 |
| NCI-SNU-5- Gastric carcinoma | 0.0 | MG-63- Osteosarcoma | 0.0 |
| KATO III- Gastric carcinoma | 18.7 | SK-LMS-1- Leiomyosarcoma (vulva) | 0.0 |
| NCI-SNU-16- Gastric carcinoma | 0.0 | SJRH30- Rhabdomyosarcoma (met to bone marrow) | 0.0 |
| NCI-SNU-1- Gastric carcinoma | 4.5 | A431- Epidermoid carcinoma | 13.2 |
| RF-1- Gastric adenocarcinoma | 0.0 | WM266-4- Melanoma | 0.0 |
| RF-48- Gastric adenocarcinoma | 0.0 | DU 145- Prostate carcinoma (brain metastasis) | 0.0 |
| MKN-45- Gastric carcinoma | 2.0 | MDA-MB-468- Breast adenocarcinoma | 74.2 |
| NCI-N87- Gastric carcinoma | 1.7 | SCC-4- Squamous cell carcinoma of tongue | 0.0 |
| OVCAR-5- Ovarian carcinoma | 6.0 | SCC-9- Squamous cell carcinoma of tongue | 0.0 |
| RL95-2- Uterine carcinoma | 3.1 | SCC-15- Squamous cell carcinoma of tongue | 0.0 |
| HelaS3- Cervical adenocarcinoma | 0.0 | CAL 27- Squamous cell carcinoma of tongue | 16.6 |

TABLE 27F

Panel 4.1D

| Tissue Name | Rel. Exp.(%) Ag1360, Run 170737092 | Tissue Name | Rel. Exp.(%) Ag1360, Run 170737092 |
|---|---|---|---|
| Secondary Th1 act | 0.0 | HUVEC IL-1 beta | 0.1 |
| Secondary Th2 act | 0.0 | HUVEC IFN gamma | 0.0 |
| Secondary Tr1 act | 0.0 | HUVEC TNF alpha + IFN gamma | 0.1 |
| Secondary Th1 rest | 0.0 | HUVEC TNF alpha + IL4 | 0.1 |
| Secondary Th2 rest | 0.0 | HUVEC IL-11 | 0.0 |
| Secondary Tr1 rest | 0.0 | Lung Microvascular EC none | 0.0 |
| Primary Th1 act | 0.0 | Lung Microvascular EC TNFalpha + IL-1 beta | 0.0 |
| Primary Th2 act | 0.0 | Microvascular Dermal EC none | 0.0 |
| Primary Th1 act | 0.0 | Microvascular Dermal EC TNFalpha + IL-1 beta | 0.0 |
| Primary Th1 rest | 0.0 | Bronchial epithelium TNFalpha + IL1 beta | 2.1 |
| Primary Th2 rest | 0.0 | Small airway epithelium none | 11.7 |

TABLE 27F-continued

Panel 4.1D

| Tissue Name | Rel. Exp.(%) Ag1360, Run 170737092 | Tissue Name | Rel. Exp.(%) Ag1360, Run 170737092 |
|---|---|---|---|
| Primary Tr1 rest | 0.0 | Small airway epithelium TNFalpha + IL-1 beta | 13.0 |
| CD45RA CD4 lymphocyte act | 0.0 | Coronery artery SMC rest | 0.5 |
| CD45RO CD4 lymphocyte act | 0.0 | Coronery artery SMC TNFalpha + IL-1 beta | 0.7 |
| CD8 lymphocyte act | 0.0 | Astrocytes rest | 0.0 |
| Secondary CD8 lymphocyte rest | 0.0 | Astrocytes TNFalpha + IL-1 beta | 0.2 |
| Secondary CD8 lymphocyte act | 0.0 | KU-812 (Basophil) rest | 1.6 |
| CD4 lymphocyte none | 0.0 | KU-812 (Basophil) PMA/ionomycin | 0.9 |
| 2ry Th1/Th2/Tr1_anti-CD95 CH11 | 0.0 | CCD1106 (Keratinocytes) none | 0.0 |
| LAK cells rest | 0.0 | CCD1106 (Keratinocytes) TNFalpha + IL-1 beta | 0.5 |
| LAK cells IL-2 | 0.0 | Liver cirrhosis | 3.3 |
| LAK cells IL-2 + IL-12 | 0.0 | NCI-H292 none | 2.3 |
| LAK cells IL-2 + IFN gamma | 0.0 | NCI-H292 IL-4 | 4.4 |
| LAK cells IL-2 + IL-18 | 0.0 | NCI-H292 IL-9 | 1.8 |
| LAK cells PMA/ionomycin | 0.0 | NCI-H292 IL-13 | 4.0 |
| NK Cells IL-2 rest | 0.0 | NCI-H292 IFN gamma | 2.7 |
| Two Way MLR 3 day | 0.0 | HPAEC none | 0.1 |
| Two Way MLR 5 day | 0.0 | HPAEC TNF alpha + IL-1 beta | 0.2 |
| Two Way MLR 7 day | 0.0 | Lung fibroblast none | 0.0 |
| PBMC rest | 0.1 | Lung fibroblast TNF alpha + IL-1 beta | 0.0 |
| PBMC PWM | 0.0 | Lung fibroblast IL-4 | 0.0 |
| PBMC PHA-L | 0.0 | Lung fibroblast IL-9 | 0.0 |
| Ramos (B cell) none | 0.0 | Lung fibroblast IL-13 | 0.1 |
| Ramos (B cell) ionomycin | 0.0 | Lung fibroblast IFN gamma | 0.1 |
| B lymphocytes PWM | 0.0 | Dermal fibroblast CCD1070 rest | 0.0 |
| B lymphocytes CD40L and IL-4 | 0.0 | Dermal fibroblast CCD1070 TNF alpha | 0.0 |
| EOL-1 dbcAMP | 0.0 | Dermal fibroblast CCD1070 IL-1 beta | 0.1 |
| EOL-1 dbcAMP PMA/ionomycin | 0.0 | Dermal fibroblast IFN gamma | 0.1 |
| Dendritic cells none | 0.0 | Dermal fibroblast IL-4 | 0.0 |
| Dendritic cells LPS | 0.0 | Dermal Fibroblasts rest | 0.1 |
| Dendritic cells anti-CD40 | 0.0 | NeutrophilsTNFa + LPS | 0.1 |
| Monocytes rest | 0.0 | Neutrophils rest | 0.0 |
| Monocytes LPS | 0.0 | Colon | 0.6 |
| Macrophages rest | 0.0 | Lung | 2.0 |
| Macrophages LPS | 0.0 | Thymus | 2.8 |
| HUVEC none | 0.0 | Kidney | 100.0 |
| HUVEC starved | 0.0 | | |

Panel 1.2 Summary: Ag1360 The expression of the CG56015-01 gene appears to be highest in a sample derived from normal kidney tissue (CT=20.7). In addition, there appears to be substantial expression in kidney cancer derived cell lines, ovarian cancer derived cell lines, colon cancer derived cell lines and normal salivary gland. Thus, the expression of this gene could be used to distinguish normal kidney from the other samples in the panel. The product of this gene is hypothesized to be involved in cellular communication. Therefore, therapeutic modulation of this gene, through the use of small molecule drugs, antibodies or protein therapeutics might be beneficial in the treatment of kidney cancer, ovarian cancer or colon cancer.

This gene product also has a moderate to high level of expression in a number of endocrine/metabolically relevant tissues, including brain, GI tract, pituitary, and liver. Thus, therapeutic modulation of this gene product may be useful in the treatment of metabolic disorders, such as obesity and diabetes.

References:

Kocher O, Cheresh P, Lee S W. Identification and partial characterization of a novel membrane-associated protein (MAP17) up-regulated in human carcinomas and modulating cell replication and tumor growth. Am J Pathol. 1996 August; 149(2):493–500.

Using the differential display technique, we have recently reported the identification of a novel gene originally designated DD96. As determined by Northern blot and in situ hybridization, DD96 was expressed at significant levels only in a single epithelial cell population, the proximal tubular epithelial cells of the kidney. However, it was diffusely expressed in various carcinomas originating from kidney, colon, lung, and breast. Using a specific polyclonal antibody, we have not determined that the DD96 protein product is a 17-kd membrane-associated protein, which we have therefore redesignated MAP17. In normal tissues, MAP17 is expressed in significant amounts only in the kidney, where it was localized to the brush border of proximal tubular epithelial cells. However, MAP17 is expressed abundantly in carcinomas arising from kidney, colon, lung, and breast, in some cases with a membrane-associated apical glandular distribution. In tissue culture, MAP17 was localized to the cell membrane in areas of cell-cell contact, ie, the distribution of cell-function-associated proteins. Transfection of a full-length wild-type DD96 cDNA clone into a colon carcinoma cell line, HT-29, markedly decreased cell proliferation in vitro and tumor growth in vivo. Although the precise function of MAP17 remains to be determined, our findings suggest that this protein may play an important role in tumor biology.

Panel 1.3D Summary: Ag1360 The expression of the CG56015-01 gene appears to be highest in a sample derived from a renal cancer cell line (CT=26.5). In addition, there appears to be substantial expression in other kidney cancer derived cell lines, ovarian cancer derived cell lines, colon cancer tissue, stomach tissue, an astrocytoma cell line a pancreatic cancer cell line and normal kidney and salivary gland. Thus, the expression of this gene could be used to distinguish normal kidney or A498 cells from the other samples in the panel. Moreover, therapeutic modulation of this gene, through the use of small molecule drugs, monoclonal antibodies or protein therapeutics may limit or block the extent of tumor cell growth and be beneficial in the treatment of kidney cancer, ovarian cancer or colon cancer.

Panel 2D Summary: Ag1360 The expression of the CG56015-01 gene was assessed in two independent runs in panel 2D with excellent concordance between the runs. Overall, the expression of this gene was highest in normal kidney tissue, a result in concordance with expression in Panels 1.2 and 1.3D. Thus, the expression of this gene could be used to distinguish normal kidney tissue from other samples in the panel. Moreover, therapeutic modulation of this gene, through the use of small molecule drugs, antibodies or protein therapeutics might be beneficial in the treatment of kidney cancer.

Panel 3D Summary: Ag1360 The expression of this gene appears to be highest in a sample derived from a renal cancer cell line (Caki-2). In addition there is substantial expression associated with other kidney cancer cell lines, colon cnacer cell lines and a breast cancer cell line. Thus, the expression of this gene could be used to distinguish Caki-2 cells from other samples in the panel. Moreover, therapeutic modulation of this gene, through the use of small molecule drugs, antibodies or protein therapeutics might be beneficial in the treatment of kidney cancer, breast cancer or colon cancer.

Panel 4.1D Summary: Ag1360 This transcript, encoding for a membrane associated epithelial protein, is highly expressed in kidney (CT 24.4). High expression of this transcript is also found in small airway and bronchial epithelium, (CT 27) and to a lower extent in the mucoepidermoid cell line H292 (CT 29). The protein encoded by this transcript appears to be involved in cell-cell communication and/or proliferation. Therefore modulation of the expression or activity of this putative protein by antibodies may be useful for the treatment of lung diseases associated with hyperplasia and/or activation of mucus producing cells such as asthma, chronic obstructive pulmonary diseases, emphysema and/or lung cancer

SEC12 (CG56035-01)

Expression of gene CG56035-01 was assessed using the primer-probe set Ag1390, described in Table 28A. Results of the RTQ-PCR runs are shown in Tables 28B, 28C, and 28D.

TABLE 28A

Probe Name Ag1390

| Primers | Sequences | | Length | Start Position |
|---|---|---|---|---|
| Forward | 5'-cccacaagagaggtatgtcact-3' | (SEQ ID NO:168) | 22 | 2129 |
| Probe | TET-5'-ttacttcccaggacatccaccctgag-3'-TAMRA | (SEQ ID NO:169) | 26 | 2155 |
| Reverse | 5'-aaaatttggcactcacatgaag-3' | (SEQ ID NO:170) | 22 | 2207 |

TABLE 28B

Panel 1.2

| Tissue Name | Rel. Exp. (%) Ag1390, Run 134918864 | Rel. Exp. (%) Ag1390, Run 138253152 | Tissue Name | Rel. Exp. (%) Ag1390, Run 134918864 | Rel. Exp. (%) Ag1390, Run 138253152 |
|---|---|---|---|---|---|
| Endothelial cells | 0.0 | 0.0 | Renal ca. 786-0 | 0.5 | 0.2 |
| Heart (Fetal) | 0.2 | 0.4 | Renal ca. A498 | 0.9 | 0.5 |
| Pancreas | 0.3 | 0.0 | Renal ca. RXF 393 | 0.1 | 0.1 |
| Pancreatic ca. CAPAN 2 | 0.0 | 0.0 | Renal ca. ACHN | 0.3 | 0.5 |
| Adrenal Gland | 7.2 | 0.1 | Renal ca. UO-31 | 0.6 | 0.5 |
| Thyroid | 0.8 | 0.1 | Renal ca. TK-10 | 0.5 | 0.4 |
| Salivary gland | 10.6 | 0.9 | Liver | 0.1 | 0.2 |
| Pituitary gland | 6.4 | 0.9 | Liver (fetal) | 0.0 | 0.0 |
| Brain (fetal) | 0.0 | 0.0 | Liver ca. (hepatoblast) HepG2 | 1.2 | 0.4 |
| Brain (whole) | 1.1 | 0.0 | Lung | 0.5 | 0.2 |
| Brain (amygdala) | 0.2 | 0.1 | Lung (fetal) | 0.0 | 0.0 |

TABLE 28B-continued

Panel 1.2

| Tissue Name | Rel. Exp. (%) Ag1390, Run 134918864 | Rel. Exp. (%) Ag1390, Run 138253152 | Tissue Name | Rel. Exp. (%) Ag1390, Run 134918864 | Rel. Exp. (%) Ag1390, Run 138253152 |
|---|---|---|---|---|---|
| Brain (cerebellum) | 0.3 | 0.1 | Lung ca. (small cell) LX-1 | 0.0 | 0.0 |
| Brain (hippocampus) | 0.3 | 0.4 | Lung ca. (small cell) NCI-H69 | 0.1 | 0.2 |
| Brain (thalamus) | 0.5 | 0.3 | Lung ca. (s.cell var.) SHP-77 | 0.0 | 0.0 |
| Cerebral Cortex | 0.1 | 0.2 | Lung ca. (large cell)NCI-H460 | 0.1 | 0.1 |
| Spinal cord | 1.2 | 0.5 | Lung ca. (non-sm. cell) A549 | 0.3 | 0.3 |
| glio/astro U87-MG | 0.1 | 0.0 | Lung ca. (non-s.cell) NCI-H23 | 0.0 | 0.0 |
| glio/astro U-118-MG | 19.1 | 2.1 | Lung ca. (non-s.cell) HOP-62 | 0.0 | 0.0 |
| astrocytoma SW1783 | 0.1 | 0.0 | Lung ca. (non-s.cl) NCI-H522 | 100.0 | 100.0 |
| neuro*; met SK-N-AS | 0.1 | 0.0 | Lung ca. (squam.) SW 900 | 0.0 | 0.0 |
| astrocytoma SF-539 | 1.1 | 0.6 | Lung ca. (squam.) NCI-H596 | 0.0 | 0.0 |
| astrocytoma SNB-75 | 0.2 | 0.1 | Mammary gland | 36.1 | 2.9 |
| glioma SNB-19 | 0.3 | 0.2 | Breast ca.* (pl.ef) MCF-7 | 0.0 | 0.0 |
| glioma U251 | 0.0 | 0.4 | Breast ca.* (pl.ef) MDA-MB-231 | 0.0 | 0.0 |
| glioma SF-295 | 0.1 | 0.2 | Breast ca.* (pl. ef) T47D | 0.2 | 0.1 |
| Heart | 2.3 | 7.3 | Breast ca. BT-549 | 0.0 | 0.0 |
| Skeletal Muscle | 2.5 | 7.2 | Breast ca. MDA-N | 0.0 | 0.1 |
| Bone marrow | 0.1 | 0.2 | Ovary | 3.8 | 6.9 |
| Thymus | 0.2 | 0.0 | Ovarian ca. OVCAR-3 | 0.0 | 0.0 |
| Spleen | 3.8 | 0.7 | Ovarian ca. OVCAR-4 | 0.0 | 0.0 |
| Lymph node | 0.5 | 0.1 | Ovarian ca. OVCAR-5 | 1.1 | 0.8 |
| Colorectal Tissue | 0.0 | 0.0 | Ovarian ca. OVCAR-8 | 0.3 | 0.1 |
| Stomach | 2.0 | 0.1 | Ovarian ca. IGROV-1 | 0.0 | 0.0 |
| Small intestine | 3.0 | 1.1 | Ovarian ca. (ascites) SK-OV-3 | 0.0 | 0.0 |
| Colon ca. SW480 | 0.0 | 0.0 | Uterus | 17.2 | 10.6 |
| Colon ca.* SW620 (SW480 met) | 0.0 | 0.0 | Placenta | 0.1 | 0.0 |
| Colon ca. HT29 | 0.0 | 0.0 | Prostate | 4.2 | 2.4 |
| Colon ca. HCT-116 | 0.0 | 0.0 | Prostate ca.* (bone met) PC-3 | 0.0 | 0.0 |
| Colon ca. CaCo-2 | 0.0 | 0.0 | Testis | 1.1 | 0.1 |
| Colon ca. Tissue (ODO3866) | 3.4 | 1.0 | Melanoma Hs688(A).T | 0.1 | 0.1 |
| Colon ca. HCC-2998 | 0.0 | 0.0 | Melanoma* (met) Hs688(B).T | 0.4 | 0.7 |
| Gastric ca.* (liver met) NCI-N87 | 0.0 | 0.0 | Melanoma UACC-62 | 0.0 | 0.0 |
| Bladder | 16.8 | 20.4 | Melanoma M14 | 0.0 | 0.0 |
| Trachea | 1.7 | 0.5 | Melanoma LOX 1MVI | 0.0 | 0.0 |
| Kidney | 4.0 | 2.3 | Melanoma* (met) SK-MEL-5 | 0.0 | 0.0 |
| Kidney (fetal) | 0.0 | 0.1 | | | |

TABLE 28C

Panel 2D

| Tissue Name | Rel. Exp. (%) Ag1390, Run 145710824 | Rel. Exp. (%) Ag1390, Run 145928345 | Tissue Name | Rel. Exp. (%) Ag1390, Run 145710824 | Rel. Exp. (%) Ag1390, Run 145928345 |
|---|---|---|---|---|---|
| Normal Colon | 6.2 | 6.7 | Kidney Margin 8120608 | 0.0 | 0.0 |
| CC Well to Mod Diff (ODO3866) | 7.3 | 12.3 | Kidney Cancer 8120613 | 0.0 | 0.0 |
| CC Margin (ODO3866) | 0.4 | 0.0 | Kidney Margin 8120614 | 0.3 | 0.3 |
| CC Gr.2 rectosigmoid (ODO3868) | 0.3 | 0.8 | Kidney Cancer 9010320 | 2.0 | 1.1 |
| CC Margin (ODO3868) | 0.3 | 0.0 | Kidney Margin 9010321 | 0.0 | 0.0 |
| CC Mod Diff (ODO3920) | 0.0 | 0.0 | Normal Uterus | 2.5 | 6.5 |
| CC Margin (ODO3920) | 0.6 | 0.4 | Uterus Cancer 064011 | 12.6 | 11.5 |
| CC Gr.2 ascend colon (ODO3921) | 4.2 | 3.9 | Normal Thyroid | 20.3 | 22.1 |
| CC Margin (ODO3921) | 0.2 | 0.4 | Thyroid Cancer 064010 | 0.0 | 0.0 |
| CC from Partial Hepatectomy (ODO4309) Mets | 1.3 | 1.5 | Thyroid Cancer A302152 | 0.8 | 0.9 |
| Liver Margin (ODO4309) | 0.0 | 0.0 | Thyroid Margin A302153 | 2.6 | 3.6 |
| Colon mets to lung (OD04451-01) | 0.4 | 0.2 | Normal Breast | 8.4 | 7.2 |
| Lung Margin (OD04451-02) | 0.0 | 0.6 | Breast Cancer (OD04566) | 0.3 | 0.2 |
| Normal Prostate 6546-1 | 8.9 | 10.8 | Breast Cancer (OD04590-01) | 14.8 | 14.4 |
| Prostate Cancer (OD04410) | 11.3 | 13.6 | Breast Cancer Mets (OD04590-03) | 34.6 | 29.9 |
| Prostate Margin (OD04410) | 0.9 | 0.8 | Breast Cancer Metastasis (OD04655-05) | 3.7 | 2.3 |
| Prostate Cancer (OD04720-01) | 5.6 | 4.4 | Breast Cancer 064006 | 7.7 | 6.8 |
| Prostate Margin (OD04720-02) | 6.3 | 8.2 | Breast Cancer 1024 | 7.7 | 9.3 |
| Normal Lung 061010 | 5.9 | 6.3 | Breast Cancer 9100266 | 6.4 | 6.7 |
| Lung Met to Muscle (ODO4286) | 0.0 | 0.1 | Breast Margin 9100265 | 3.7 | 5.8 |
| Muscle Margin (ODO4286) | 3.9 | 14.4 | Breast Cancer A209073 | 6.6 | 9.5 |
| Lung Malignant Cancer (OD03126) | 4.9 | 7.9 | Breast Margin A2090734 | 3.4 | 1.5 |
| Lung Margin (OD03126) | 0.6 | 2.1 | Normal Liver | 0.0 | 0.0 |
| Lung Cancer (OD04404) | 3.1 | 3.8 | Liver Cancer 064003 | 0.1 | 0.2 |
| Lung Margin (OD04404) | 3.5 | 7.3 | Liver Cancer 1025 | 0.0 | 0.0 |
| Lung Cancer (OD04565) | 3.4 | 1.6 | Liver Cancer 1026 | 1.0 | 1.1 |
| Lung Margin (OD04565) | 0.4 | 0.3 | Liver Cancer 6004-T | 0.5 | 0.0 |
| Lung Cancer (OD04237-01) | 5.0 | 3.7 | Liver Tissue 6004-N | 1.7 | 1.3 |
| Lung Margin (OD04237-02) | 2.0 | 4.3 | Liver Cancer 6005-T | 0.7 | 0.2 |
| Ocular Mel Met to Liver (ODO4310) | 0.2 | 0.0 | Liver Tissue 6005-N | 0.0 | 0.0 |
| Liver Margin (ODO4310) | 0.0 | 0.1 | Normal Bladder | 23.2 | 20.9 |
| Melanoma Mets to Lung (OD04321) | 0.0 | 0.2 | Bladder Cancer 1023 | 2.7 | 2.1 |
| Lung Margin (OD04321) | 1.4 | 1.2 | Bladder Cancer A302173 | 14.1 | 11.5 |
| Normal Kidney | 0.0 | 1.2 | Bladder Cancer (OD04718-01) | 1.7 | 1.4 |

TABLE 28C-continued

| | Panel 2D | | | | |
|---|---|---|---|---|---|
| Tissue Name | Rel. Exp. (%) Ag1390, Run 145710824 | Rel. Exp. (%) Ag1390, Run 145928345 | Tissue Name | Rel. Exp. (%) Ag1390, Run 145710824 | Rel. Exp. (%) Ag1390, Run 145928345 |
| Kidney Ca, Nuclear grade 2 (OD04338) | 0.4 | 0.4 | Bladder Normal Adjacent (OD04718-03) | 12.1 | 12.8 |
| Kidney Margin (OD04338) | 0.3 | 0.5 | Normal Ovary | 5.9 | 5.1 |
| Kidney Ca Nuclear grade 1/2 (OD04339) | 0.0 | 0.2 | Ovarian Cancer 064008 | 100.0 | 100.0 |
| Kidney Margin (OD04339) | 0.7 | 0.8 | Ovarian Cancer (OD04768-07) | 1.7 | 4.1 |
| Kidney Ca, Clear cell type (OD04340) | 0.2 | 0.5 | Ovary Margin (OD04768-08) | 7.1 | 6.7 |
| Kidney Margin (OD04340) | 0.8 | 2.3 | Normal Stomach | 1.6 | 1.5 |
| Kidney Ca, Nuclear grade 3 (OD04348) | 0.0 | 0.3 | Gastric Cancer 9060358 | 1.3 | 0.8 |
| Kidney Margin (OD04348) | 0.5 | 0.2 | Stomach Margin 9060359 | 0.0 | 0.2 |
| Kidney Cancer (OD04622-01) | 0.3 | 0.2 | Gastric Cancer 9060395 | 10.1 | 13.0 |
| Kidney Margin (OD04622-03) | 0.0 | 0.0 | Stomach Margin 9060394 | 1.8 | 1.3 |
| Kidney Cancer (OD04450-01) | 0.3 | 0.0 | Gastric Cancer 9060397 | 18.3 | 24.8 |
| Kidney Margin (OD04450-03) | 0.0 | 0.2 | Stomach Margin 9060396 | 0.0 | 0.0 |
| Kidney Cancer 8120607 | 3.3 | 3.3 | Gastric Cancer 064005 | 3.1 | 3.9 |

TABLE 28D

| | Panel 4D | | |
|---|---|---|---|
| Tissue Name | Rel. Exp.(%) Ag1390, Run 162674334 | Tissue Name | Rel. Exp.(%) Ag1390, Run 162674334 |
| Secondary Th1 act | 0.0 | HUVEC IL-1 beta | 0.0 |
| Secondary Th2 act | 0.0 | HUVEC IFN gamma | 0.0 |
| Secondary Tr1 act | 0.0 | HUVEC TNF alpha + IFN gamma | 0.9 |
| Secondary Th1 rest | 0.0 | HUVEC TNF alpha + IL4 | 0.0 |
| Secondary Th2 rest | 100.0 | HUVEC IL-11 | 0.0 |
| Secondary Tr1 rest | 0.0 | Lung Microvascular EC none | 0.0 |
| Primary Th1 act | 0.0 | Lung Microvascular EC TNFalpha + IL-1 beta | 0.0 |
| Primary Th2 act | 0.0 | Microvascular Dermal EC none | 0.0 |
| Primary Tr1 act | 0.0 | Microvascular Dermal EC TNFalpha + IL-1 beta | 0.0 |
| Primary Th1 rest | 0.0 | Bronchial epithelium TNFalpha + IL1 beta | 0.0 |
| Primary Th2 rest | 0.0 | Small airway epithelium none | 0.0 |
| Primary Tr1 rest | 0.0 | Small airway epithelium TNFalpha + IL-1 beta | 0.0 |
| CD45RA CD4 lymphocyte act | 0.0 | Coronery artery SMC rest | 27.5 |
| CD45RO CD4 lymphocyte act | 0.0 | Coronery artery SMC TNFalpha + IL-1 beta | 10.5 |
| CD8 lymphocyte act | 0.0 | Astrocytes rest | 8.0 |
| Secondary CD8 lymphocyte rest | 0.0 | Astrocytes TNFalpha + IL-1 beta | 36.9 |
| Secondary CD8 lymphocyte act | 0.7 | KU-812 (Basophil) rest | 0.0 |
| CD4 lymphocyte none | 0.0 | KU-812 (Basophil) PMA/ionomycin | 0.0 |
| 2ry Th1/Th2/Th1_anti-CD95 CH11 | 0.0 | CCD1106 (Keratinocytes) none | 0.0 |
| LAK cells rest | 0.0 | CCD1106 (Keratinocytes) TNFalpha + IL-1 beta | 0.0 |
| LAK cells IL-2 | 0.0 | Liver cirrhosis | 1.2 |
| LAK cells IL-2 + IL-12 | 1.8 | Lupus kidney | 0.8 |

TABLE 28D-continued

Panel 4D

| Tissue Name | Rel. Exp.(%) Ag1390, Run 162674334 | Tissue Name | Rel. Exp.(%) Ag1390, Run 162674334 |
| --- | --- | --- | --- |
| LAK cells IL-2 + IFN gamma | 0.0 | NCI-H292 none | 0.0 |
| LAK cells IL-2 + IL-18 | 1.3 | NCI-H292 IL-4 | 0.0 |
| LAK cells PMA/ionomycin | 0.0 | NCI-H292 IL-9 | 0.0 |
| NK Cells IL-2 rest | 1.8 | NCI-H292 IL-13 | 0.0 |
| Two Way MLR 3 day | 0.7 | NCI-H292 IFN gamma | 0.0 |
| Two Way MLR 5 day | 0.0 | HPAEC none | 0.0 |
| Two Way MLR 7 day | 0.0 | HPAEC TNF alpha + IL-1 beta | 0.0 |
| PBMC rest | 1.1 | Lung fibroblast none | 0.7 |
| PBMC PWM | 0.0 | Lung fibroblast TNF alpha + IL-1 beta | 0.0 |
| PBMC PHA-L | 0.0 | Lung fibroblast IL-4 | 2.5 |
| Ramos (B cell) none | 0.0 | Lung fibroblast IL-9 | 1.3 |
| Ramos (B cell) ionomycin | 0.0 | Lung fibroblast IL-13 | 1.6 |
| B lymphocytes PWM | 0.0 | Lung fibroblast IFN gamma | 1.3 |
| B lymphocytes CD40L and IL-4 | 0.0 | Dermal fibroblast CCD1070 rest | 0.0 |
| EOL-1 dbcAMP | 0.0 | Dermal fibroblast CCD1070 TNF alpha | 0.0 |
| EOL-1 dbcAMP PMA/ionomycin | 0.8 | Dermal fibroblast CCD1070 IL-1 beta | 0.0 |
| Dendritic cells none | 1.7 | Dermal fibroblast IFN gamma | 0.0 |
| Dendritic cells LPS | 3.2 | Dermal fibroblast IL-4 | 0.0 |
| Dendritic cells anti-CD40 | 1.2 | IBD Colitis 2 | 0.0 |
| Monocytes rest | 1.6 | IBD Crohn's | 0.0 |
| Monocytes LPS | 0.0 | Colon | 1.4 |
| Macrophages rest | 1.9 | Lung | 32.8 |
| Macrophages LPS | 0.0 | Thymus | 7.6 |
| HUVEC none | 0.0 | Kidney | 10.7 |
| HUVEC starved | 0.0 | | |

AI_comprehensive panel_v1.0 Summary: Ag1390 Results from one experiment with the CG56035-01 gene are not included. The amp plot indicates that there were experimental difficulties with this run.

CNS_neurodegeneration_v1.0 Summary: Ag1390 Expression of the CG56035-01 gene is low/undetectable (CTs>35) across all of the samples on this panel (data not shown).

Panel 1.2 Summary: Ag1390 The expression of the CG56035-01 gene was assessed in two independent runs in panel 1.2 with good concordance between runs. The expression of this gene appears to be highest in a sample derived from a lung cancer cell line (NCI-H522)(CTs=24). Thus, the expression of this gene could be used to distinguish NCI-H522 cells from other samples in the panel. Frizzled 4 genes, to which this gene is a homolog, act as soluble modulators of Wnt signaling. The WNT signaling cascade is involved in regulation of cytoskeletal rearrangements, apoptosis, and proliferation. Therefore, therapeutic modulation of this gene, through the use of small molecule drugs, protein therapeutics or antibodies might be beneficial in the treatment of lung cancer.

The pattern of expression of this isoform of this gene indicates that it may also have an important function in endocrine/metabolic physiology. Moderate to high levels of expression can be found in adrenal, brain, GI tract, pancreas, pituitary and thyroid. Thus, this gene product may be involved in the diagnosis and/or treatment of metabolic disorders, including obesity and diabetes.

In addition, higher levels of expression of this gene in lung (CTs=32–33) and liver (CTs=31–32) than in fetal lung and liver (CTs=36) suggest that it can also be used to differentiate between the adult and fetal forms of lung and liver.

Panel 2D Summary: Ag1390 The expression of the CG56035-01 gene was assessed in two independent runs in panel 2D with excellent concordance between runs. The expression of this gene appears to be highest in a sample derived from an ovarian cancer (CTs=30). In addition, there appears to be substantial expression associated with breast cancer. Thus, the expression of this gene could be used to distinguish this ovarian cancer sample from other samples in the panel. Moreover, therapeutic modulation of this gene, through the use of small molecule drugs, protein therapeutics or antibodies might be beneficial in the treatment of breast or ovarian cancer.

Panel 3D Summary: Ag1390 Expression of the CG56035-01 gene is low/undetectable (CTs>35) across all of the samples on this panel (data not shown).

Panel 4D Summary: Ag1390 Highest expression of the CG56035-01 transcript is found in secondary Th2 rest cells (CT=31.7), but is absent in other T cells. Expression of this transcript is also found in the lung. This transcript encodes for a secreted frizzled related protein that are reported to antagonize the WNT/frizzled pathway. Since lung inflammatory diseases such as asthma and chronic obstructive pulmonary diseases are mediated by Th2 cells, this protein may be involved in the lung pathology associated with these Th2 T cells. Therefore, therapeutics designed against the protein encoded by this gene may be useful for the treatment of lung inflammatory diseases. This transcript is also expressed in astrocytes treated with TNF-a and IL-1 indicating that therapeutics designed against the protein encoded by this gene may be useful for the treatment of inflammatory CNS diseases such as multiple sclerosis.

SEC5 (CG56153-01)

Expression of gene CG56153-01 was assessed using the primer-probe set Ag1749, described in Table 29A. Results of the RTQ-PCR runs are shown in Tables 29B, 29C, 29D, 29E, 29F and 29G.

TABLE 29A

PROBE NAME Ag1749

| Primers | Sequences | | Length | Start Position |
|---|---|---|---|---|
| forward | 5'-ttactgggtaggattcgctttt-3' | (SEQ ID NO:171) | 22 | 216 |
| Probe | TET-5'-aaatcctccagggacacagcccatt-3'-TAMRA | (SEQ ID NO:172) | 25 | 240 |
| Reverse | 5'-gggagtacctgaacacctcact-3' | (SEQ ID NO:173) | 22 | 271 |

TABLE 29B

CNS_neurodegeneration_v1.0

| Tissue Name | Rel. Exp.(%) Ag1749, Run 207625049 | Tissue Name | Rel. Exp.(%) Ag1749, Run 207625049 |
|---|---|---|---|
| AD 1 Hippo | 27.4 | Control (Path) 3 Temporal Ctx | 2.5 |
| AD 2 Hippo | 86.5 | Control (Path) 4 Temporal Ctx | 11.1 |
| AD 3 Hippo | 14.2 | AD 1 Occipital Ctx | 5.3 |
| AD 4 Hippo | 26.4 | AD 2 Occipital Ctx (Missing) | 0.0 |
| AD 5 Hippo | 28.9 | AD 3 Occipital Ctx | 2.6 |
| AD 6 Hippo | 72.2 | AD 4 Occipital Ctx | 14.5 |
| Control 2 Hippo | 100.0 | AD 5 Occipital Ctx | 1.6 |
| Control 4 Hippo | 43.5 | AD 6 Occipital Ctx | 100.0 |
| Control (Path) 3 Hippo | 9.3 | Control 1 Occipital Ctx | 2.5 |
| AD 1 Temporal Ctx | 2.9 | Control 2 Occipital Ctx | 59.9 |
| AD 2 Temporal Ctx | 24.7 | Control 3 Occipital Ctx | 6.7 |
| AD 3 Temporal Ctx | 1.6 | Control 4 Occipital Ctx | 7.2 |
| AD 4 Temporal Ctx | 11.3 | Control (Path) 1 Occipital Ctx | 81.8 |
| AD 5 lnf Temporal Ctx | 23.0 | Control (Path) 2 Occipital Ctx | 10.6 |
| AD 5 SupTemporal Ctx | 56.6 | Control (Path) 3 Occipital Ctx | 0.7 |
| AD 6 Inf Temporal Ctx | 12.3 | Control (Path) 4 Occipital Ctx | 11.1 |
| AD 6 Sup Temporal Ctx | 10.3 | Control 1 Parietal Ctx | 5.4 |
| Control 1 Temporal Ctx | 3.7 | Control 2 Parietal Ctx | 12.2 |
| Control 2 Temporal Ctx | 55.1 | Control 3 Parietal Ctx | 12.2 |
| Control 3 Temporal Ctx | 14.2 | Control (Path) 1 Parietal Ctx | 52.5 |
| Control 4 Temporal Ctx | 4.2 | Control (Path) 2 Parietal Ctx | 43.5 |
| Control (Path) 1 Temporal Ctx | 50.0 | Control (Path) 3 Parietal Ctx | 3.2 |
| Control (Path) 2 Temporal Ctx | 31.0 | Control (Path) 4 Parietal Ctx | 25.9 |

TABLE 29C

Panel 1.3D

| Tissue Name | Rel. Exp.(%) Ag1749, Run 152485756 | Tissue Name | Rel. Exp.(%) Ag1749, Run 152485756 |
|---|---|---|---|
| Liver adenocarcinoma | 0.0 | Kidney (fetal) | 0.4 |
| Pancreas | 0.0 | Renal ca. 786-0 | 0.0 |
| Pancreatic ca. CAPAN 2 | 0.0 | Renal ca. A498 | 0.0 |
| Adrenal gland | 0.2 | Renal ca. RXF 393 | 0.0 |
| Thyroid | 0.0 | Renal ca. ACHN | 0.0 |
| Salivary gland | 0.1 | Renal ca. UO-31 | 0.0 |
| Pituitary gland | 100.0 | Renal ca. TK-10 | 0.0 |
| Brain (fetal) | 13.5 | Liver | 0.0 |
| Brain (whole) | 4.4 | Liver (fetal) | 0.0 |
| Brain (amygdala) | 15.9 | Liver ca. (hepatoblast) HepG2 | 0.0 |
| Brain (cerebellum) | 0.8 | Lung | 0.0 |
| Brain (hippocampus) | 21.3 | Lung (fetal) | 3.5 |
| Brain (substantia nigra) | 0.7 | Lung ca. (small cell) LX-1 | 0.0 |

TABLE 29C-continued

Panel 1.3D

| Tissue Name | Rel. Exp.(%) Ag1749, Run 152485756 | Tissue Name | Rel. Exp.(%) Ag1749, Run 152485756 |
|---|---|---|---|
| Brain (thalamus) | 2.2 | Lung ca. (small cell) NCI-H69 | 0.0 |
| Cerebral Cortex | 12.5 | Lung ca. (s.cell var.) SHP-77 | 0.0 |
| Spinal cord | 3.3 | Lung ca. (large cell) NCI-H460 | 0.0 |
| glio/astro U87-MG | 0.0 | Lung ca. (non-sm. cell) A549 | 0.0 |
| glio/astro U-118-MG | 0.0 | Lung ca. (non-s.cell) NCI-H23 | 0.0 |
| astrocytoma SW1783 | 0.0 | Lung ca. (non-s.cell) HOP-62 | 0.0 |
| neuro*; met SK-N-AS | 0.0 | Lung ca. (non-s.cl) NCI-H522 | 0.0 |
| astrocytoma SF-539 | 0.0 | Lung ca. (squam.) SW 900 | 0.0 |
| astrocytoma SNB-75 | 0.0 | Lung ca. (squam.) NCI-H596 | 0.0 |
| glioma SNB-19 | 0.0 | Mammary gland | 2.5 |
| glioma U251 | 0.0 | Breast ca.* (pl.ef) MCF-7 | 0.0 |
| glioma SF-295 | 0.0 | Breast ca.* (pl.ef) MDA-MB-231 | 0.0 |
| Heart (fetal) | 0.8 | Breast ca.* (pl.ef) T47D | 0.0 |
| Heart | 0.0 | Breast ca. BT-549 | 0.0 |
| Skeletal muscle (fetal) | 23.2 | Breast ca. MDA-N | 0.0 |
| Skeletal muscle | 0.0 | Ovary | 1.6 |
| Bone marrow | 0.0 | Ovarian ca. OVCAR-3 | 0.0 |
| Thymus | 1.5 | Ovarian ca. OVCAR-4 | 0.0 |
| Spleen | 0.1 | Ovarian ca. OVCAR-5 | 0.0 |
| Lymph node | 0.2 | Ovarian ca. OVCAR-8 | 0.0 |
| Colorectal | 2.9 | Ovarian ca. IGROV-1 | 0.0 |
| Stomach | 0.4 | Ovarian ca.* (ascites) SK-OV-3 | 0.0 |
| Small intestine | 1.5 | Uterus | 0.0 |
| Colon ca. SW480 | 0.0 | Placenta | 18.7 |
| Colon ca.* SW620(SW480 met) | 0.0 | Prostate | 0.0 |
| Colon ca. HT29 | 0.0 | Prostate ca.* (bone met)PC-3 | 0.1 |
| Colon ca. HCT-116 | 0.0 | Testis | 1.2 |
| Colon ca. CaCo-2 | 0.0 | Melanoma Hs688(A).T | 0.0 |
| Colon ca. tissue(ODO3866) | 0.2 | Melanoma* (met) Hs688(B).T | 0.0 |
| Colon ca. HCC-2998 | 0.0 | Melanoma UACC-62 | 0.0 |
| Gastric ca.* (liver met) NCI-N87 | 0.0 | Melanoma M14 | 0.0 |
| Bladder | 0.0 | Melanoma LOX IMVI | 0.0 |
| Trachea | 0.1 | Melanoma* (met) SK-MEL-5 | 0.0 |
| Kidney | 0.0 | Adipose | 1.4 |

TABLE 29D

Panel 2D

| Tissue Name | Rel. Exp.(%) Ag1749, Run 152685549 | Tissue Name | Rel. Exp.(%) Ag1749, Run 152685549 |
|---|---|---|---|
| Normal Colon | 32.5 | Kidney Margin 8120608 | 0.0 |
| CC Well to Mod Diff (ODO3866) | 9.6 | Kidney Cancer 8120613 | 0.0 |
| CC Margin (ODO3866) | 38.4 | Kidney Margin 8120614 | 2.3 |
| CC Gr.2 rectosigmoid (ODO3868) | 13.5 | Kidney Cancer 9010320 | 0.0 |
| CC Margin (ODO3868) | 78.5 | Kidney Margin 9010321 | 0.0 |
| CC Mod Diff (ODO3920) | 0.0 | Normal Uterus | 0.0 |
| CC Margin (ODO3920) | 64.6 | Uterus Cancer 064011 | 3.5 |
| CC Gr.2 ascend colon (ODO3921) | 6.8 | Normal Thyroid | 6.9 |
| CC Margin (ODO3921) | 34.6 | Thyroid Cancer 064010 | 0.0 |

TABLE 29D-continued

Panel 2D

| Tissue Name | Rel. Exp.(%) Ag1749, Run 152685549 | Tissue Name | Rel. Exp.(%) Ag1749, Run 152685549 |
|---|---|---|---|
| CC from Partial Hepatectomy (ODO4309) Mets | 0.0 | Thyroid Cancer A302152 | 0.0 |
| Liver Margin (ODO4309) | 0.0 | Thryoid Margin A302153 | 2.1 |
| Colon mets to lung (OD04451-01) | 0.0 | Normal Breast | 51.1 |
| Lung Margin (OD04451-02) | 0.0 | Breast Cancer (OD04566) | 2.8 |
| Normal Prostate 6546-1 | 11.7 | Breast Cancer (OD04590-01) | 12.0 |
| Prostate Cancer (OD04410) | 9.9 | Breast Cancer Mets (OD04590-03) | 74.2 |
| Prostate Margin (OD04410) | 11.7 | Breast Cancer Metastasis (OD04655-05) | 6.8 |
| Prostate Cancer (OD04720-01) | 5.6 | Breast Cancer 064006 | 2.8 |
| Prostate Margin (OD04720-02) | 16.6 | Breast Cancer 1024 | 8.1 |
| Normal Lung 061010 | 6.2 | Breast Cancer 9100266 | 2.3 |
| Lung Met to Muscle (ODO4286) | 0.0 | Breast Margin 9100265 | 15.2 |
| Muscle Margin (ODO4286) | 8.7 | Breast Cancer A209073 | 3.7 |
| Lung Malignant Cancer (OD03126) | 7.3 | Breast Margin A2090734 | 9.1 |
| Lung Margin (OD03126) | 5.4 | Normal Liver | 0.0 |
| Lung Cancer (OD04404) | 4.3 | Liver Cancer 064003 | 0.0 |
| Lung Margin (OD04404) | 0.0 | Liver Cancer 1025 | 0.0 |
| Lung Cancer (OD04565) | 6.0 | Liver Cancer 1026 | 0.0 |
| Lung Margin (OD04565) | 9.2 | Liver Cancer 6004-T | 0.0 |
| Lung Cancer (OD04237-01) | 0.0 | Liver Tissue 6004-N | 0.0 |
| Lung Margin (OD04237-02) | 1.4 | Liver Cancer 6005-T | 0.0 |
| Ocular Mel Met to Liver (ODO4310) | 0.0 | Liver Tissue 6005-N | 0.0 |
| Liver Margin (ODO4310) | 0.0 | Normal Bladder | 0.0 |
| Melanoma Mets to Lung (OD04321) | 0.0 | Bladder Cancer 1023 | 1.9 |
| Lung Margin (OD04321) | 0.0 | Bladder Cancer A302173 | 0.0 |
| Normal Kidney | 2.4 | Bladder Cancer (OD04718-01) | 3.3 |
| Kidney Ca, Nuclear grade 2 (OD04338) | 0.0 | Bladder Normal Adjacent (OD04718-03) | 100.0 |
| Kidney Margin (OD04338) | 0.0 | Normal Ovary | 12.2 |
| Kidney Ca Nuclear grade 1/2 (OD04439) | 0.0 | Ovarian Cancer 064008 | 4.0 |
| Kidney Margin (OD04339) | 0.0 | Ovarian Cancer (OD04768-07) | 0.0 |
| Kidney Ca, Clear cell type (OD04340) | 0.0 | Ovary Margin (OD04768-08) | 5.8 |
| Kidney Margin (OD04340) | 0.0 | Normal Stomach | 95.9 |
| Kidney Ca, Nuclear grade 3 (OD04348) | 0.0 | Gastric Cancer 9060358 | 49.0 |
| Kidney Margin (OD04348) | 0.0 | Stomach Margin 9060359 | 16.4 |
| Kidney Cancer (OD04622-01) | 0.0 | Gastric Cancer 9060395 | 13.1 |
| Kidney Margin (OD04622-03) | 0.0 | Stomach Margin 9060394 | 9.7 |
| Kidney Cancer (OD04450-01) | 0.0 | Gastric Cancer 9060397 | 0.0 |
| Kidney Margin (OD04450-03) | 0.0 | Stomach Margin 9060396 | 9.8 |
| Kidney Cancer 8120607 | 0.0 | Gastric Cancer 064005 | 29.9 |

TABLE 29E

Panel 4D

| Tissue Name | Rel. Exp.(%) Ag1749, Run 152685550 | Tissue Name | Rel. Exp.(%) Ag1749, Run 152685550 |
|---|---|---|---|
| Secondary Th1 act | 9.2 | HUVEC IL-1 beta | 15.3 |
| Secondary Th2 act | 6.7 | HUVEC IFN gamma | 90.1 |
| Secondary Tr1 act | 2.3 | HUVEC TNF alpha + IFN gamma | 13.3 |
| Secondary Th1 rest | 0.0 | HUVEC TNF alpha + IL4 | 21.5 |
| Secondary Th2 rest | 0.0 | HUVEC IL-11 | 37.1 |
| Secondary Tr1 rest | 0.8 | Lung Microvascular EC none | 0.0 |
| Primary Th1 act | 0.0 | Lung Microvascular EC TNFalpha + IL-1 beta | 0.0 |
| Primary Th2 act | 0.0 | Microvascular Dermal EC none | 4.1 |

TABLE 29E-continued

Panel 4D

| Tissue Name | Rel. Exp.(%) Ag1749, Run 152685550 | Tissue Name | Rel. Exp.(%) Ag1749, Run 152685550 |
|---|---|---|---|
| Primary Tr1 act | 0.0 | Microvasular Dermal EC TNFalpha + IL-1 beta | 3.4 |
| Primary Th1 rest | 3.2 | Bronchial epithelium TNFalpha + IL1 beta | 0.0 |
| Primary Th2 rest | 4.4 | Small airway epithelium none | 0.0 |
| Primary Tr1 rest | 0.0 | Small airway epithelium TNFalpha + IL-1 beta | 0.0 |
| CD45RA CD4 lymphocyte act | 3.3 | Coronery artery SMC rest | 0.0 |
| CD45RO CD4 lymphocyte act | 5.6 | Coronery artery SMC TNFalpha + IL-1 beta | 0.0 |
| CD8 lymphocyte act | 5.9 | Astrocytes rest | 78.5 |
| Secondary CD8 lymphocyte rest | 4.2 | Astrocytes TNFalpha + IL-1 beta | 24.8 |
| Secondary CD8 lymphocyte act | 1.2 | KU-812 (Basophil) rest | 0.0 |
| CD4 lymphocyte none | 0.0 | KU-812 (Basophil) PMA/ionomycin | 0.0 |
| 2ry Th1/Th2/Tr1_anti-CD95 CH11 | 0.0 | CCD1106 (Keratinocytes) none | 0.0 |
| LAK cells rest | 0.0 | CCD1106 (Keratinocytes) TNFalpha + IL-1 beta | 0.0 |
| LAK cells IL-2 | 0.0 | Liver cirrhosis | 0.0 |
| LAK cells IL-2 + IL-12 | 2.0 | Lupus kidney | 0.0 |
| LAK cells IL-2 + IFN gamma | 0.0 | NCI-H292 none | 0.0 |
| LAK cells IL-2 + IL-18 | 0.0 | NCI-H292 IL-4 | 0.0 |
| LAK cells PMA/ionomycin | 0.0 | NCI-H292 IL-9 | 1.1 |
| NK Cells IL-2 rest | 2.0 | NCI-H292 IL-13 | 0.0 |
| Two Way MLR 3 day | 0.0 | NCI-H292 IFN gamma | 0.8 |
| Two Way MLR 5 day | 1.2 | HPAEC none | 0.0 |
| Two Way MLR 7 day | 3.8 | HPAEC TNF alpha + IL-1 beta | 0.0 |
| PBMC rest | 0.0 | Lung fibroblast none | 2.1 |
| PBMC PWM | 3.3 | Lung fibroblast TNF alpha + IL-1 beta | 2.3 |
| PBMC PHA-L | 6.1 | Lung fibroblast IL-4 | 1.6 |
| Ramos (B cell) none | 0.0 | Lung fibroblast IL-9 | 2.0 |
| Ramos (B cell) ionomycin | 0.0 | Lung fibroblast IL-13 | 1.4 |
| B lymphocytes PWM | 16.6 | Lung fibroblast IFN gamma | 3.7 |
| B lymphocytes CD40L and IL-4 | 1.0 | Dermal fibroblast CCD1070 rest | 0.0 |
| EOL-1 dbcAMP | 0.0 | Dermal fibroblast CCD1070 TNF alpha | 0.0 |
| EOL-1 dbcAMP PMA/ionomycin | 0.0 | Dermal fibroblast CCD1070 IL-1 beta | 2.3 |
| Dendritic cells none | 0.0 | Dermal fibroblast IFN gamma | 0.0 |
| Dendritic cells LPS | 0.0 | Dermal fibroblast IL-4 | 0.0 |
| Dendritic cells anti-CD40 | 0.0 | IBD Colitis 2 | 17.2 |
| Monocytes rest | 0.0 | IBD Crohn's | 0.9 |
| Monocytes LPS | 0.0 | Colon | 29.9 |
| Macrophages rest | 4.5 | Lung | 1.1 |
| Macrophages LPS | 2.2 | Thymus | 0.0 |
| HUVEC none | 58.2 | Kidney | 57.8 |
| HUVEC starved | 100.0 | | |

TABLE 29F

Panel 5 Islet

| Tissue Name | Rel. Exp.(%) Ag1749, Run 172371514 | Tissue Name | Rel Exp.(%) Ag1749, Run 172371514 |
|---|---|---|---|
| 97457_Patient-02go_adipose | 3.5 | 94709_Donor 2 AM - A_adipose | 0.0 |
| 97476_Patient-07sk_skeletal muscle | 1.1 | 94710_Donor 2 AM - B_adipose | 0.0 |
| 97477_Patient-07ut_uterus | 0.0 | 94711_Donor 2 AM - C_adipose | 0.0 |
| 97478_Patient-07pl_placenta | 100.0 | 94712_Donor 2 AD - A_adipose | 0.0 |

TABLE 29F-continued

Panel 5 Islet

| Tissue Name | Rel. Exp.(%) Ag1749, Run 172371514 | Tissue Name | Rel. Exp.(%) Ag1749, Run 172371514 |
|---|---|---|---|
| 99167_Bayer Patient 1 | 1.2 | 94713_Donor 2 AD - B_adipose | 0.0 |
| 97482_Patient-08ut_uterus | 5.1 | 94714_Donor 2 AD - C_adipose | 0.0 |
| 97483_Patient-08pl_placenta | 13.5 | 94742_Donor 3 U - A_Mesenchymal Stem Cells | 0.0 |
| 97486_Patient-09sk_skeletal muscle | 0.6 | 94743_Donor 3 U - B_Mesenchymal Stem Cells | 0.0 |
| 97487_Patient-09ut_uterus | 0.0 | 94730_Donor 3 AM - A_adipose | 0.0 |
| 97488_Patient-09pl_placenta | 28.7 | 94731_Donor 3 AM —B_adipose | 0.0 |
| 97492_Patient-10ut_uterus | 1.0 | 94732_Donor 3 AM - C_adipose | 0.0 |
| 97493_Patient-10pl_placenta | 69.7 | 94733_Donor 3 AD - A_adipose | 0.0 |
| 97495_Patient-11go_adipose | 0.0 | 94734_Donor 3 AD - B_adipose | 0.0 |
| 97496_Patient-11sk_skeletal muscle | 0.0 | 94735_Donor 3 AD - C_adipose | 0.0 |
| 97497_Patient-11ut_uterus | 0.0 | 77138_Liver_HepG2untreated | 0.0 |
| 97498_Patient-11pl_placenta | 24.3 | 73556_Heart_Cardiac stromal cells (primary) | 1.2 |
| 97500_Patient-12go_adipose | 3.3 | 81735_Small Intestine | 2.5 |
| 97501_Patient-12sk_skeletal muscle | 0.5 | 72409_Kidney_Proximal Convoluted Tubule | 0.0 |
| 97502_Patient-12ut_uterus | 0.0 | 82685_Small intestine_Duodenum | 0.0 |
| 97503_Patient-12pl_placenta | 18.3 | 90650_Adrenal_Adrenocortical adenoma | 0.0 |
| 94721_Donor 2 U - A_Mesenchymal Stem Cells | 0.0 | 72410_Kidney_HRCE | 00 |
| 94722_Donor 2 U - B_Mesenchymal Stem Cells | 0.0 | 72411_Kidney_HRE | 15.6 |
| 94723_Donor 2 U - C_Mesenchymal Stem Cells | 0.6 | 73139_Uterus_Uterine smooth muscle cells | 3.2 |

TABLE 29G

Panel 5D

| Tissue Name | Rel. Exp.(%) Ag1749, Run 169269329 | Tissue Name | Rel. Exp.(%) Ag1749, Run 169269329 |
|---|---|---|---|
| 97457_Patient-02go_adipose | 1.6 | 94709_Donor 2 AM - A_adipose | 0.0 |
| 97476_Patient-07sk_skeletal muscle | 2.0 | 94710_Donor 2 AM - B_adipose | 0.0 |
| 97477_Patient-07ut_uterus | 0.0 | 94711_Donor 2 AM - C_adipose | 0.0 |
| 97478_Patient-07pl_placenta | 100.0 | 94712_Donor 2 AD - A_adipose | 0.0 |
| 97481_Patient-08sk_skeletal muscle | 3.5 | 94713_Donor 2 AD - B_adipose | 0.0 |
| 97482_Patient-08ut_uterus | 0.4 | 94714_Donor 2 AD - C_adipose | 0.0 |
| 97483_Patient-08pl_placenta | 14.1 | 94742_Donor 3 U - A_Mesenchymal Stem Cells | 0.0 |
| 97486_Patient-09sk_skeletal muscle | 0.6 | 94743_Donor 3 U - B_Mesenchymal Stem Cells | 0.0 |
| 97487_Patient-09ut_uterus | 0.0 | 94730_Donor 3 AM - A_adipose | 0.0 |
| 97488_Patient-09pl_placenta | 42.9 | 94731_Donor 3 AM - B_adipose | 0.0 |
| 97492_Patient-10ut_uterus | 0.0 | 94732_Donor 3 AM - C_adipose | 0.2 |
| 97493_Patient-10pl_placenta | 96.6 | 94733_Donor 3 AD - A_adipose | 0.0 |
| 97495_Patient-11go_adipose | 2.1 | 94734_Donor 3 AD - B_adipose | 0.0 |
| 97496_Patient-11sk_skeletal muscle | 0.7 | 94735_Donor 3 AD - C_adipose | 0.0 |
| 97497_Patient-11ut_uterus | 0.0 | 77138_Liver_HepG2untreated | 0.3 |
| 97498_Patient-11pl_placenta | 57.8 | 73556_Heart_Cardiac stromal cells (primary) | 0.5 |
| 97500_Patient-12go_adipose | 2.4 | 81735_Small Intestine | 5.1 |

TABLE 29G-continued

Panel 5D

| Tissue Name | Rel. Exp.(%) Ag1749, Run 169269329 | Tissue Name | Rel. Exp.(%) Ag1749, Run 169269329 |
|---|---|---|---|
| 97501_Patient-12sk_skeletal muscle | 2.9 | 72409_Kidney_Proximal Convoluted Tubule | 0.0 |
| 97502_Patient-12ut_uterus | 0.0 | 82685_Small intestine_Duodenum | 0.0 |
| 97503_Patient-12pl_placenta | 23.3 | 90650_Adrenal_Adrenocortical adenoma | 0.0 |
| 94721_Donor 2 U - A_Mesenchymal Stem Cells | 0.0 | 72410_Kidney_HRCE | 0.0 |
| 94722_Donor 2 U - B_Mesenchymal Stem Cells | 0.0 | 72411_Kidney_HRE | 13.0 |
| 94723_Donor 2 U - C_Mesenchymal Stem Cells | 0.0 | 73139_Uterus_Uterine smooth muscle cells | 0.4 |

CNS_neurodegeneration_v1.0 Summary: Ag1749 This panel does not show differential expression of the CG56153-01 gene in Alzheimer's disease. However, this expression profile confirms the presence of this gene in the brain. Please see Panel 1.3D for discussion of this gene in the central nervous system.

Panel 1.3D Summary: Ag1749 The expression of the CG56153-01 gene is highest in a sample derived from the pituitary gland (CT=28.2). This is in concordance with published reports (see reference below). In addition, there is low but substantial expression in various brain tissues as well as placenta tissue. The expression pattern of this isoform of the neuronatin gene eludes to its developmental importance (see references below). Expression in this gene is higher in fetal lung (CT=33) and skeletal muscle (CT=30) than in the corresponding adult tissues. Thus, the expression of this gene could be used to distinguish pituitary gland tissue from other tissues in the panel. In addition, this gene and/or gene product can be used to differentiate between the adult and fetal forms of skeletal muscle and lung. Furthermore, the expression in fetal tissue suggests that this gene product may be involved in the development of these organs and thus may be useful in treating disease that affect the lung and skeletal muscle. This gene encodes a putative proteolipid that may function as a unique regulator of ion channels during brain development and therefore may also be useful in the treatment of neurodevelopmental disorders.

References:

Usui H, Morii K, Tanaka R, Tamura T, Washiyama K, Ichikawa T, Kumanishi T.cDNA cloning and mRNA expression analysis of the human neuronatin. High level expression in human pituitary gland and pituitary adenomas. J Mol Neurosci 1997 August;9(1):55–60

The authors cloned the nearly complete cDNA of human neuronatin with the aid of an expressed sequence tag (EST) database, and analyzed its expression in various human tissues by Northern blot analysis. The nucleotide and deduced amino acid sequences of the human neuronatin showed a high similarity to those of rodents. The Northern blot analysis revealed that the human neuronatin message was expressed predominantly in the fetal brain in the brain-specific manner, but only faintly in the adult brain. Among the various adult human tissues examined, the anterior pituitary gland was shown to be the only place where the neuronatin mRNA was strongly expressed. Intense neuronatin expression was also observed in several human pituitary adenomas, including ACTH-producing, GH-producing, and nonfunctioning adenomas, but hardly detected in other brain tumors.

PMID: 9356927

Dou D, Joseph R. Cloning of human neuronatin gene and its localization to chromosome-20q 11.2-12: the deduced protein is a novel "proteolipid'. Brain Res 1996 Jun. 3;723 (1–2):8–22

Human brain development is a continuum governed by differential gene expression. Therefore, we proceeded to identify genes selectively expressed in the developing brain. Using differential display and library screening, a novel rat cDNA, neuronatin, was identified and used to screen a human fetal brain cDNA library. Human neuronatin cDNA was isolated and sequenced. The cDNA was 1159 bp long and corresponded in size to the 1.25 kb message detected on Northern analysis. Neuronatin mRNA was selectively expressed in human brain during fetal development, but became repressed in adulthood. When studied in the rat, neuronatin mRNA first appeared at mid-gestation in association with the onset of neurogenesis, becoming most pronounced later in development when neuroepithelial proliferation and neuroblast commitment are manifest, and declined postnatally coinciding with the completion of neurogenesis. The deduced protein has two distinct domains, a hydrophobic N-terminal and basic C-terminal rich in arginine residues. Both the amino acid sequence and secondary structure of this amphipathic polypeptide exhibited homology to PMP1 and phospholamban, members of the "proteolipid' class of proteins which function as regulatory subunits of membrane channels. The neuronatin gene, 3973 bases long, contains in its 5'-flanking region a neural restrictive silencer element which may govern neuron-specific expression. Based on screening a somatic cell hybrid panel, neuronatin gene was assigned to chromosome-20. And, using deletion constructs of chromosome-20 and fluorescence in situ hybridization, neuronatin was localized to chromosome-20q11.2-12. In conclusion, neuronatin is a novel human gene that is developmentally regulated and expressed in the brain. The deduced protein is a proteolipid that may function as a unique regulator of ion channels during brain development. The definitive localization of neuronatin to human chromosome 20q11.2-12 provides the basis to investigate this gene as a candidate in neurodevelopmental diseases that may also map to this region.

PMID: 8813377

Panel 2D Summary: Ag1749 The expression of the CG56153-01 gene appears to be highest in a sample derived from normal bladder tissue adjacent to a bladder malignancy (CT=33.6). In addition, there is substantial expression associated with normal stomach tissue, breast tissue and a number of normal colon tissue samples adjacent to malignant colon. This preferential expression in normal tissue samples is in agreement with the expression in Panel 1.3D. Thus, the expression of this gene could be used to distinguish this normal bladder tissue sample from the other samples in the panel. Moreover, therapeutic modulation of this gene, through the use of small molecule drugs, antibodies or protein therapeutics might be beneficial in the treatment of colon cancer, bladder cancer, breast cancer or gastric cancer.

Panel 4D Summary: Ag1749 The CG56153-01 gene, a neuronatin homolog is expressed at moderate to low levels in HUVEC cells resting, serum-starved, and activated with IFN-gamma, as well as resting astrocytes and kidney (CTs32.8–33.44). This putative protein product is a proteolipid that may function as a regulator of ion channels in these cells and tissues, similar to its putative function in brain development. Antibodies and small molecules that antagonize the function of the CG56153-01 product may reduce or eliminate the symptoms in patients with autoimmune and inflammatory diseases in which endothelial cells and astrocytes are involved, such as lupus erythematosus, asthma, emphysema, Crohn's disease, ulcerative colitis, multiple sclerosis, rheumatoid arthritis, osteoarthritis, and psoriasis.

Panels 5 Islet and 5D Summary: Ag1749 The expression pattern of the CG56153-01 gene, which encodes a neuronatin isoform, indicates an importance in placental function and regulation. The placental tissue samples were collected from nondiabetic obese women (patients 7 and 9), a diabetic patient on insulin and classified as overweight (patient 10), and finally a women diagnosed with diabetes and on insulin (patient 12). Furthermore, the expression of this gene in placenta confirms the importance of the gene product in the development of the fetus.

SEC7 (CG56159-01)

Expression of gene CG56159-01 was assessed using the primer-probe sets Ag1910 and Ag2047, described in Tables 30A and 30B. Results of the RTQ-PCR runs are shown in Tables 30C, 30D and 30E.

TABLE 30A

| PROBE NAME Ag1910 | | | | |
|---|---|---|---|---|
| Primers | Sequences | | Length | Start Position |
| Forward | 5'-tcctgaacaggtacctgagcta-3' | (SEQ ID NO:174) | 22 | 2579 |
| Probe | TET-5'-aagcaggacgccacctctaccatcat-3'-TAMRA | (SEQ ID NO:175) | 26 | 2626 |
| Reverse | 5'-caatgacgttgttggtaatgc-3' | (SEQ ID NO:176) | 21 | 2654 |

TABLE 30

| PROBE NAME Ag2047 | | | | |
|---|---|---|---|---|
| Primers | Sequences | | Length | Start Position |
| Forward | 5'-tcctgaacaggtacctgagcta-3' | (SEQ ID NO:177) | 22 | 2579 |
| Probe | TET-5'-aagcaggacgccacctctaccatcat-3'-TAMRA | (SEQ ID NO:178) | 26 | 2626 |
| Reverse | 5'-caatgacgttgttggtaatgc-3' | (SEQ ID NO:179) | 21 | 2654 |

TABLE 30

| | Panel 1.3D | | | | | | |
|---|---|---|---|---|---|---|---|
| Tissue Name | Rel. Exp.(%) Ag1910, Run 147571473 | Rel. Exp.(%) Ag1910, Run 165534505 | Rel. Exp.(%) Ag2047, Run 165627343 | Tissue Name | Rel. Exp.(%) Ag1910, Run 147571473 | Rel. Exp.(%) Ag1910, Run 165534505 | Rel. Exp.(%) Ag2047, Run 165627343 |
| Liver adenocarcinoma | 0.0 | 0.1 | 0.1 | Kidney (fetal) | 5.6 | 7.9 | 10.3 |
| Pancreas | 27.7 | 51.1 | 73.7 | Renal ca. 786-0 | 0.0 | 0.0 | 0.0 |
| Pancreatic ca. CAPAN 2 | 0.0 | 0.0 | 0.0 | Renal ca. A498 | 15.4 | 12.5 | 9.2 |
| Adrenal gland | 0.3 | 0.6 | 0.4 | Renal ca. RXF 393 | 4.3 | 22.8 | 17.4 |
| Thyroid | 0.5 | 0.3 | 0.3 | Renal ca. ACHN | 0.0 | 0.0 | 0.0 |
| Salivary gland | 0.4 | 0.9 | 0.4 | Renal ca. UO-31 | 1.3 | 1.3 | 1.4 |
| Pituitary gland | 0.2 | 0.2 | 0.3 | Renal ca. TK-10 | 0.0 | 0.0 | 0.0 |
| Brain (fetal) | 0.0 | 0.4 | 0.1 | Liver | 6.0 | 25.0 | 20.9 |
| Brain (whole) | 0.2 | 1.8 | 0.3 | Liver (fetal) | 26.8 | 24.8 | 29.9 |
| Brain (amygdala) | 0.1 | 0.1 | 0.3 | Liver ca. (hepatoblast) HepG2 | 11.4 | 10.5 | 8.3 |
| Brain (cerebellum) | 0.0 | 0.1 | 0.1 | Lung | 0.2 | 4.4 | 4.2 |
| Brain (hippocampus) | 0.1 | 0.4 | 0.5 | Lung (fetal) | 0.8 | 1.8 | 1.1 |

TABLE 30-continued

Panel 1.3D

| Tissue Name | Rel. Exp.(%) Ag1910, Run 147571473 | Rel. Exp.(%) Ag1910, Run 165534505 | Rel. Exp.(%) Ag2047, Run 165627343 | Tissue Name | Rel. Exp.(%) Ag1910, Run 147571473 | Rel. Exp.(%) Ag1910, Run 165534505 | Rel. Exp.(%) Ag2047, Run 165627343 |
|---|---|---|---|---|---|---|---|
| Brain (substantia nigra) | 0.1 | 0.3 | 0.3 | Lung ca. (small cell) LX-1 | 0.0 | 0.0 | 0.0 |
| Brain (thalamus) | 0.1 | 0.6 | 0.4 | Lung ca. (small cell) NCI-H69 | 0.0 | 0.0 | 0.0 |
| Cerebral Cortex | 0.6 | 0.2 | 0.2 | Lung ca. (s.cell var.) SHP-77 | 0.2 | 0.1 | 0.1 |
| Spinal cord | 0.9 | 1.5 | 1.0 | Lung ca. (large cell)NCI-H460 | 0.0 | 0.1 | 0.4 |
| glio/astro U87-MG | 0.0 | 0.0 | 0.0 | Lung ca. (non-sm. cell) A549 | 0.6 | 0.5 | 0.4 |
| glio/astro U-118-MG | 22.7 | 22.2 | 17.9 | Lung ca. (non-s.cell) NCI-H23 | 0.3 | 0.3 | 0.3 |
| astrocytoma SW1783 | 7.5 | 10.9 | 7.5 | Lung ca. (non-s.cell) HOP-62 | 1.4 | 1.4 | 1.8 |
| neuro*; met SK-N-AS | 6.9 | 3.4 | 2.7 | Lung ca. (non-s.cl) NCI-H522 | 0.0 | 0.0 | 0.0 |
| astrocytoma SF-539 | 3.3 | 6.6 | 3.2 | Lung ca. (squam.) SW 900 | 0.0 | 0.0 | 0.0 |
| astrocytoma SNB-75 | 5.3 | 4.5 | 3.7 | Lung ca. (squam.) NCI-H596 | 0.0 | 0.0 | 0.0 |
| glioma SNB-19 | 0.0 | 0.1 | 0.0 | Mammary gland | 7.7 | 6.3 | 2.7 |
| glioma U251 | 0.0 | 0.1 | 0.0 | Breast ca.* (pl.ef) MCF-7 | 0.0 | 0.1 | 0.0 |
| glioma SF-295 | 0.0 | 0.1 | 0.0 | Breast ca.* (pl.ef) MDA-MB-231 | 0.0 | 0.0 | 0.0 |
| Heart (fetal) | 2.0 | 0.3 | 0.2 | Breast ca.* (pl.ef) T47D | 0.0 | 0.0 | 0.0 |
| Heart | 0.1 | 0.6 | 0.6 | Breast ca. BT-549 | 100.0 | 100.0 | 100.0 |
| Skeletal muscle (fetal) | 7.3 | 0.5 | 0.5 | Breast ca. MDA-N | 0.0 | 0.0 | 0.0 |
| Skeletal muscle | 0.1 | 0.7 | 0.5 | Ovary | 3.1 | 0.8 | 0.5 |
| Bone marrow | 4.2 | 5.6 | 5.8 | Ovarian ca. OVCAR-3 | 0.2 | 0.1 | 0.1 |
| Thymus | 0.2 | 0.3 | 0.3 | Ovarian ca. OVCAR-4 | 0.0 | 0.1 | 0.0 |
| Spleen | 1.0 | 2.1 | 1.7 | Ovarian ca. OVCAR-5 | 0.0 | 0.0 | 0.0 |
| Lymph node | 0.5 | 1.8 | 1.2 | Ovarian ca. OVCAR-8 | 1.3 | 1.9 | 1.0 |
| Colorectal | 3.3 | 1.6 | 1.3 | Ovarian ca. IGROV-1 | 0.0 | 0.0 | 0.0 |
| Stomach | 2.7 | 2.4 | 1.9 | Ovarian ca.* (ascites) SK-OV-3 | 8.2 | 11.3 | 10.4 |
| Small intestine | 27.2 | 94.0 | 73.7 | Uterus | 0.0 | 0.5 | 0.5 |
| Colon ca. SW480 | 0.0 | 0.0 | 0.0 | Placenta | 1.5 | 1.1 | 1.1 |
| Colon ca.* SW620(SW480 met) | 0.0 | 0.0 | 0.0 | Prostate | 14.2 | 22.4 | 25.9 |
| Colon ca. HT29 | 0.0 | 0.0 | 0.0 | Prostate ca.* (bone met)PC-3 | 1.3 | 3.7 | 2.2 |
| Colon ca. HCT-116 | 0.0 | 0.0 | 0.0 | Testis | 0.2 | 0.3 | 0.2 |
| Colon ca. CaCo-2 | 1.0 | 0.2 | 0.2 | Melanoma Hs688(A).T | 28.3 | 4.3 | 4.2 |
| Colon ca. | 4.9 | 2.8 | 3.5 | Melanoma* | 53.2 | 5.4 | 7.0 |

TABLE 30-continued

Panel 1.3D

| Tissue Name | Rel. Exp.(%) Ag1910, Run 147571473 | Rel. Exp.(%) Ag1910, Run 165534505 | Rel. Exp.(%) Ag2047, Run 165627343 | Tissue Name | Rel. Exp.(%) Ag1910, Run 147571473 | Rel. Exp.(%) Ag1910, Run 165534505 | Rel. Exp.(%) Ag2047, Run 165627343 |
|---|---|---|---|---|---|---|---|
| tissue(ODO3866) | | | | (met) Hs688(B).T | | | |
| Colon ca. HCC-2998 | 0.0 | 0.0 | 0.0 | Melanoma UACC-62 | 0.0 | 0.0 | 0.1 |
| Gastric ca.* (liver met) NCI-N87 | 0.0 | 0.0 | 0.0 | Melanoma M14 | 0.0 | 0.0 | 0.0 |
| Bladder | 14.8 | 22.5 | 19.6 | Melanoma LOX IMVI | 0.8 | 1.2 | 1.4 |
| Trachea | 1.2 | 2.3 | 2.0 | Melanoma* (met) SK-MEL-5 | 0.0 | 0.0 | 0.0 |
| Kidney | 10.7 | 46.7 | 37.9 | Adipose | 1.8 | 1.0 | 0.9 |

TABLE 30D

Panel 2.2

| Tissue Name | Rel. Exp.(%) Ag1910, Run 174285074 | Tissue Name | Rel. Exp.(%) Ag1910, Run 174285074 |
|---|---|---|---|
| Normal Colon | 6.5 | Kidney Margin (OD04348) | 24.1 |
| Colon cancer (OD06064) | 1.7 | Kidney malignant cancer (OD06204B) | 0.0 |
| Colon Margin (OD06064) | 20.4 | Kidney normal adjacent tissue (OD06204E) | 22.8 |
| Colon cancer (OD06159) | 0.2 | Kidney Cancer (OD04450-01) | 100.0 |
| Colon Margin (OD06159) | 28.3 | Kidney Margin (OD04450-03) | 10.7 |
| Colon cancer (OD06297-04) | 0.3 | Kidney Cancer 8120613 | 0.1 |
| Colon Margin (OD06297-015) | 10.5 | Kidney Margin 8120614 | 46.0 |
| CC Gr.2 ascend colon (ODO3921) | 2.4 | Kidney Cancer 9010320 | 0.9 |
| CC Margin (ODO3921) | 4.7 | Kidney Margin 9010321 | 17.6 |
| Colon cancer metastasis (OD06104) | 0.7 | Kidney Cancer 8120607 | 0.6 |
| Lung Margin (OD06104) | 37.1 | Kidney Margin 8120608 | 26.1 |
| Colon mets to lung (OD04451-01) | 0.2 | Normal Uterus | 0.1 |
| Lung Margin (OD04451-02) | 0.5 | Uterine Cancer 064011 | 0.2 |
| Normal Prostate | 15.4 | Normal Thyroid | 0.2 |
| Prostate Cancer (OD04410) | 0.4 | Thyroid Cancer 064010 | 0.1 |
| Prostate Margin (OD04410) | 2.1 | Thyroid Cancer A302152 | 0.7 |
| Normal Ovary | 0.7 | Thyroid Margin A302153 | 0.0 |
| Ovarian cancer (OD06283-03) | 0.5 | Normal Breast | 2.5 |
| Ovarian Margin (OD06283-07) | 0.3 | Breast Cancer (OD04566) | 1.6 |
| Ovarian Cancer 064008 | 1.4 | Breast Cancer 1024 | 1.8 |
| Ovarian cancer (OD06145) | 0.8 | Breast Cancer (OD04590-01) | 0.4 |
| Ovarian Margin (OD06145) | 0.7 | Breast Cancer Mets (OD04590-03) | 0.5 |
| Ovarian cancer (OD06455-03) | 0.0 | Breast Cancer Metastasis (OD04655-05) | 0.7 |
| Ovarian Margin (OD06455-07) | 0.2 | Breast Cancer 064006 | 0.9 |
| Normal Lung | 0.9 | Breast Cancer 9100266 | 0.6 |
| Invasive poor diff. lung adeno (ODO4945-01) | 1.2 | Breast Margin 9100265 | 0.7 |
| Lung Margin (ODO4945-03) | 2.1 | Breast Cancer A209073 | 0.4 |
| Lung Malignant Cancer (OD03126) | 1.1 | Breast Margin A2090734 | 2.8 |
| Lung Margin (OD03126) | 0.7 | Breast cancer (OD06083) | 1.8 |
| Lung Cancer (OD05014A) | 0.7 | Breast cancer node metastasis (OD06083) | 0.5 |
| Lung Margin (OD05014B) | 1.5 | Normal Liver | 22.7 |
| Lung cancer (OD06081) | 0.2 | Liver Cancer 1026 | 10.4 |
| Lung Margin (OD06081) | 1.0 | Liver Cancer 1025 | 40.3 |

TABLE 30D-continued

Panel 2.2

| Tissue Name | Rel. Exp.(%) Ag1910, Run 174285074 | Tissue Name | Rel. Exp.(%) Ag1910, Run 174285074 |
|---|---|---|---|
| Lung Cancer (OD04237-01) | 0.3 | Liver Cancer 6004-T | 23.3 |
| Lung Margin (OD04237-02) | 2.0 | Liver Tissue 6004-N | 3.3 |
| Ocular Melanoma Metastasis | 0.0 | Liver Cancer 6005-T | 20.6 |
| Ocular Melanoma Margin (Liver) | 10.9 | Liver Tissue 6005-N | 41.5 |
| Melanoma Metastasis | 0.1 | Liver Cancer 064003 | 4.8 |
| Melanoma Margin (Lung) | 1.7 | Normal Bladder | 13.9 |
| Normal Kidney | 9.6 | Bladder Cancer 1023 | 0.5 |
| Kidney Ca, Nuclear grade 2 (OD04338) | 16.3 | Bladder Cancer A302173 | 0.3 |
| Kidney Margin (OD04338) | 14.5 | Normal Stomach | 2.5 |
| Kidney Ca Nuclear grade 1/2 (OD04339) | 0.3 | Gastric Cancer 9060397 | 2.2 |
| Kidney Margin (OD04339) | 32.1 | Stomach Margin 9060396 | 7.3 |
| Kidney Ca, Clear cell type (OD04340) | 4.8 | Gastric Cancer 9060395 | 0.8 |
| Kidney Margin (OD04340) | 9.3 | Stomach Margin 9060394 | 24.5 |
| Kidney Ca, Nuclear grade 3 (OD04348) | 0.4 | Gastric Cancer 064005 | 26.1 |

TABLE 30

Panel 4D

| Tissue Name | Rel. Exp. (%) Ag1910, Run 159550646 | Rel. Exp. (%) Ag2047, Run 161706228 | Tissue Name | Rel. Exp. (%) Ag1910, Run 159550646 | Rel. Exp. (%) Ag2047, Run 161706228 |
|---|---|---|---|---|---|
| Secondary Th1 act | 0.0 | 0.0 | HUVEC IL-1beta | 4.0 | 2.3 |
| Secondary Th2 act | 0.0 | 0.0 | HUVEC IFN gamma | 7.5 | 5.8 |
| Secondary Tr1 act | 0.0 | 0.1 | HUVEC TNF alpha + IFN gamma | 14.2 | 10.2 |
| Secondary Th1 rest | 0.0 | 0.0 | HUVEC TNF alpha + IL4 | 19.9 | 17.7 |
| Secondary Th2 rest | 0.0 | 0.0 | HUVEC IL-11 | 5.6 | 3.3 |
| Secondary Tr1 rest | 0.1 | 0.0 | Lung Microvascular EC none | 6.3 | 4.6 |
| Primary Th1 act | 0.0 | 0.0 | Lung Microvascular EC TNFalpha + IL-1beta | 4.3 | 4.1 |
| Primary Th2 act | 0.0 | 0.0 | Microvascular Dermal EC none | 6.3 | 5.6 |
| Primary Tr1 act | 0.0 | 0.0 | Microvascular Dermal EC TNFalpha + IL-1beta | 4.2 | 2.9 |
| Primary Th1 rest | 0.1 | 0.0 | Bronchial epithelium TNFalpha + IL1beta | 0.3 | 0.4 |
| Primary Th2 rest | 0.1 | 0.0 | Small airway epithelium none | 0.4 | 0.3 |
| Primary Tr1 rest | 0.0 | 0.0 | Small airway epithelium TNFalpha + IL-1beta | 0.0 | 0.1 |
| CD45RA CD4 lymphocyte act | 5.2 | 2.7 | Coronery artery SMC rest | 6.1 | 4.4 |
| CD45RO CD4 lymphocyte act | 0.0 | 0.0 | Coronery artery SMC TNFalpha + IL-1beta | 4.9 | 2.9 |
| CD8 lymphocyte act | 0.0 | 0.0 | Astrocytes rest | 0.0 | 0.0 |
| Secondary CD8 lymphocyte rest | 0.0 | 0.0 | Astrocytes TNFalpha + IL-1beta | 0.1 | 0.1 |
| Secondary CD8 lymphocyte act | 0.0 | 0.0 | KU-812 (Basophil) rest | 1.2 | 0.8 |
| CD4 lymphocyte none | 0.0 | 0.0 | KU-812 (Basophil) PMA/ionomycin | 2.5 | 2.1 |
| 2ry Th1/Th2/Tr1_anti-CD95 CH11 | 0.1 | 0.1 | CCD1106 (Keratinocytes) none | 11.0 | 7.6 |
| LAK cells rest | 3.9 | 2.6 | CCD1106 (Keratinocytes) TNFalpha + IL-1beta | 1.2 | 1.2 |
| LAK cells IL-2 | 0.0 | 0.0 | Liver cirrhosis | 2.8 | 1.7 |

TABLE 30-continued

Panel 4D

| Tissue Name | Rel. Exp. (%) Ag1910, Run 159550646 | Rel. Exp. (%) Ag2047, Run 161706228 | Tissue Name | Rel. Exp. (%) Ag1910, Run 159550646 | Rel. Exp. (%) Ag2047, Run 161706228 |
| --- | --- | --- | --- | --- | --- |
| LAK cells IL-2 + IL-12 | 0.3 | 0.2 | Lupus kidney | 1.6 | 1.2 |
| LAK cells IL-2 + IFN gamma | 0.7 | 0.1 | NCI-H292 none | 0.0 | 0.0 |
| LAK cells IL-2 + IL-18 | 0.2 | 0.2 | NCI-H292 IL-4 | 0.0 | 0.0 |
| LAK cells PMA/ionomycin | 16.3 | 12.8 | NCI-H292 IL-9 | 0.0 | 0.0 |
| NK Cells IL-2 rest | 0.0 | 0.0 | NCI-H292 IL-13 | 0.0 | 0.0 |
| Two Way MLR 3 day | 1.7 | 1.4 | NCI-H292 IFN gamma | 0.0 | 0.0 |
| Two Way MLR 5 day | 1.2 | 0.8 | HPAEC none | 5.9 | 4.2 |
| Two Way MLR 7 day | 0.2 | 0.2 | HPAEC TNF alpha + IL-1 beta | 9.0 | 5.8 |
| PBMC rest | 0.9 | 0.7 | Lung fibroblast none | 3.1 | 2.2 |
| PBMC PWM | 2.5 | 1.8 | Lung fibroblast TNF alpha + IL-1 beta | 6.0 | 5.0 |
| PBMC PHA-L | 1.8 | 1.6 | Lung fibroblast IL-4 | 13.6 | 11.7 |
| Ramos (B cell) none | 0.0 | 0.0 | Lung fibroblast IL-9 | 6.2 | 3.6 |
| Ramos (B cell) ionomycin | 0.0 | 0.0 | Lung fibroblast IL-13 | 9.3 | 6.1 |
| B lymphocytes PWM | 0.1 | 0.1 | Lung fibroblast IFN gamma | 6.2 | 5.3 |
| B lymphocytes CD40L and IL-4 | 0.3 | 0.3 | Dermal fibroblast CCD1070 rest | 19.3 | 15.6 |
| EOL-1 dbcAMP | 0.0 | 0.0 | Dermal fibroblast CCD1070 TNF alpha | 26.1 | 17.8 |
| EOL-1 dbcAMP PMA/ionomycin | 0.0 | 0.0 | Dermal fibroblast CCD1070 IL-1 beta | 18.3 | 12.8 |
| Dendritic cells none | 29.5 | 19.5 | Dermal fibroblast IFN gamma | 48.0 | 29.3 |
| Dendritic cells LPS | 29.5 | 24.0 | Dermal fibroblast IL-4 | 88.3 | 62.4 |
| Dendritic cells anti-CD40 | 23.0 | 13.9 | IBD Colitis 2 | 0.0 | 0.0 |
| Monocytes rest | 5.6 | 3.3 | IBD Crohn's | 6.4 | 3.1 |
| Monocytes LPS | 20.7 | 16.5 | Colon | 100.0 | 100.0 |
| Macrophages rest | 8.1 | 6.5 | Lung | 2.0 | 1.4 |
| Macrophages LPS | 13.4 | 8.7 | Thymus | 47.0 | 25.2 |
| HUVEC none | 19.6 | 17.2 | Kidney | 0.6 | 0.3 |
| HUVEC starved | 18.0 | 14.8 | | | |

Panel 1.3D Summary: Ag1910/Ag2047 Three experiments with the same probe and primer set produce results that are in excellent agreement, with highest expression of the CG56159-01 gene in a breast cancer cell line (BT549) (CTs=24–25). Thus, expression of this gene could be used to distinguish BT549 cells from other samples in the panel. There is also significant expression in clusters of cell lines derived from renal cancer, brain cancer and melanoma. This gene encodes a homolog of aminopeptidase N, which is thought to be critical in the metastasis of cancer by degrading extracellular matrix and aiding in cellular motility. Thus, therapeutic modulation of the expression or function of this protein may be useful in the treatment of these cancers or any metastatic cancer.

In addition, the expression of this homolog of Aminopeptidase N is moderate to high in several of the endocrine/metabolic tissues found on this panel, including adipose, liver, pancreas, skeletal muscle and small intestine. Aminopeptidase N (EC 3.4.11.2) is located in the small-intestinal and renal microvillar membranes, and also in other plasma membranes. In the small intestine, aminopeptidase N plays a role in the final digestion of peptides generated from hydrolysis of proteins by gastric and pancreatic proteases. Its function in proximal tubular epithelial cells and other cell types is less clear.

Panel 2.2 Summary: Ag1910 The expression of the CG56159-01 gene appears to be highest in a sample derived from a kidney cancer (CT=26.1). In addition, there appears to be substantial expression associated with liver derived tissue, normal colon tissue and a number of normal kidney tissue samples. This is consistent with the expression in Panel 1.3D and the function of this putative protein. (Please see Panel 1.3D for detailed discussion). Thus, the expression of this gene could be used to distinguish this kidney cancer sample from the other samples in the panel. Moreover, therapeutic modulation of this gene, through the use of small molecule drugs, protein therapeutics or antibodies might be of benefit in the treatment of liver cancer, colon cancer or kidney cancer.

Panel 4D Summary: Ag1910/Ag2047 Two experiments with the same probe and primer set produce results that are in excellent agreement, with highest expression of the CG56159-01 gene in the colon (CTs=21–23). This is in concordance with the identification of this gene product as an aminopeptidase N homolog. Recently aminopeptidase N has been implicated in leukocyte chemotaxis and activation. Consistent with this presumed role in the immunologic events of inflammatory and allergic diseases, this gene product is also expressed in a wide range of other cell types of significance in the immune response in health and disease.

Thus, significant levels of expression are also seen in treated and untreated lung and dermal fibroblasts and treated and untreated endothelial cells, macrophages and monocytes. The transcript is more highly expressed in resting macrophages and monocytes than in treated cells of these types. Thus, the protein encoded by this transcript may be important in monocytic differentiation and activation and in conditions which involve endothelial cells. Therefore, regulating the expression of this transcript or the function of the protein it encodes could alter the types and levels of monocytic cells regulated by cytokine and chemokine production and T cell activation. Furthermore, antibodies and small molecules that antagonize the function of the this product may reduce or eliminate the symptoms in patients with autoimmune and inflammatory diseases, such as lupus erythematosus, asthma, emphysema, Crohn's disease, ulcerative colitis, arthritis, and psoriasis.

References:

Tani K, Ogushi F, Shimizu T, Sone S. Protease-induced leukocyte chemotaxis and activation: roles in host defense and inflammation. J Med Invest 2001 August;48(3–4): 133–41

The migration of leukocytes such as neutrophils, monocytes and lymphocytes into inflamed lesions is one of the critical events of inflammation. Although the traditional function of neutrophil-derived antimicrobial proteases is to ingest and kill bacteria, some neutrophil serine proteases have been shown to induce leukocyte migration and activation. Mast cell-derived chymase also has the chemotactic activity for leukocytes. During the acute phase of inflammatory and allergic diseases, the predominantly migrated cells are neutrophils and mast cells, respectively, and in the subsequent chronic phase, monocytes and lymphocytes are mainly migrated. The chemotactic activity for monocytes and lymphocytes of neutrophil-derived serine proteases and mast cell-derived chymase may have a role in switching acute inflammation to chronic inflammation and delayed-type hypersensitivity. Recently, aminopeptidase N and endothelin were shown to induce chemotactic migration of leukocytes. Thus, protease-induced leukocyte chemotaxis and activation may play an important role in immunologic events of inflammatory and allergic diseases.

PMID: 11694952

SEC9 (CG56162-01)

Expression of gene CG56162-01 was assessed using the primer-probe sets Ag1952, Ag1906 and Ag2042, described in Tables 31A, 31B and 31C. Results of the RTQ-PCR runs are shown in Tables 31D, 31E, 31F, 31G and 31H.

TABLE 31A

PROBE NAME Ag1952

| Primers | Sequences | | Length | Start Position |
|---|---|---|---|---|
| Forward | 5'-gaccagggtcatatttgcacta-3' | (SEQ ID NO:180) | 22 | 1916 |
| Probe | TET-5'-cctcctgaggtaacagcaagtcccat-3'-TAMRA | (SEQ ID NO:181) | 26 | 1943 |
| Reverse | 5'-cgggaatactttcccttcta-3' | (SEQ ID NO:182) | 21 | 1970 |

TABLE 31B

PROBE NAME Ag1906

| Primers | Sequences | | Length | Start Position |
|---|---|---|---|---|
| Forward | 5'-gtactcatttcgcctctggtt-3' | (SEQ ID NO:183) | 21 | 3895 |
| Probe | TET-5'-tgcaacaactttcaaggtccttgctg-3'-TAMRA | (SEQ ID NO:184) | 26 | 3852 |
| Reverse | 5'-agcacaaggttgagcactttc-3' | (SEQ ID NO:185) | 21 | 3830 |

TABLE 31C

PROBE NAME Ag2042

| Primers | Sequences | | Length | Start Position |
|---|---|---|---|---|
| Forward | 5'-cataatggaaacaggacctgaa-3' | (SEQ ID NO:186) | 22 | 4354 |
| Probe | TET-5'-ccttccagcatgccagaggaaagtt-3'-TAMRA | (SEQ ID NO:187) | 25 | 4326 |
| Reverse | 5'-aggtcctggtagggaatgct-3' | (SEQ ID NO:188) | 20 | 4286 |

TABLE 31D

CNS_neurodegeneration_v1.0

| Tissue Name | Rel. Exp.(%) Ag1952, Run 207776409 | Tissue Name | Rel. Exp.(%) Ag1952, Run 207776409 |
|---|---|---|---|
| AD 1 Hippo | 18.0 | Control (Path) 3 Temporal Ctx | 22.7 |
| AD 2 Hippo | 43.8 | Control (Path) 4 Temporal Ctx | 46.7 |
| AD 3 Hippo | 12.1 | AD 1 Occipital Ctx | 22.1 |
| AD 4 Hippo | 9.0 | AD 2 Occipital Ctx (Missing) | 0.0 |
| AD 5 Hippo | 100.0 | AD 3 Occipital Ctx | 20.6 |
| AD 6 Hippo | 46.7 | AD 4 Occipital Ctx | 35.8 |
| Control 2 Hippo | 24.7 | AD 5 Occipital Ctx | 49.7 |
| Control 4 Hippo | 16.7 | AD 6 Occipital Ctx | 23.0 |
| Control (Path) 3 Hippo | 11.8 | Control 1 Occipital Ctx | 17.7 |
| AD 1 Temporal Ctx | 26.6 | Control 2 Occipital Ctx | 71.7 |
| AD 2 Temporal Ctx | 51.8 | Control 3 Occipital Ctx | 27.7 |
| AD 3 Temporal Ctx | 24.0 | Control 4 Occipital Ctx | 17.8 |
| AD 4 Temporal Ctx | 37.9 | Control (Path) 1 Occipital Ctx | 95.9 |
| AD 5 Inf Temporal Ctx | 93.3 | Control (Path) 2 Occipital Ctx | 17.8 |
| AD 5 Sup Temporal Ctx | 44.8 | Control (Path) 3 Occipital Ctx | 12.6 |
| AD 6 Inf Temporal Ctx | 59.5 | Control (Path) 4 Occipital Ctx | 27.4 |
| AD 6 Sup Temporal Ctx | 59.9 | Control 1 Parietal Ctx | 22.5 |
| Control 1 Temporal Ctx | 28.1 | Control 2 Parietal Ctx | 64.2 |
| Control 2 Temporal Ctx | 68.8 | Control 3 Parietal Ctx | 23.2 |
| Control 3 Temporal Ctx | 31.0 | Control (Path) 1 Parietal Ctx | 98.6 |
| Control 3 Temporal Ctx | 21.0 | Control (Path) 2 Parietal Ctx | 37.1 |
| Control (Path) 1 Temporal Ctx | 94.6 | Control (Path) 3 Parietal Ctx | 17.6 |
| Control (Path) 2 Temporal Ctx | 61.1 | Control (Path) 4 Parietal Ctx | 64.2 |

TABLE 31E

Panel 1.3D

| Tissue Name | Rel. Exp. (%) Ag1906. Run 147697143 | Rel. Exp. (%) Ag2042. Run 165627321 | Tissue Name | Rel. Exp. (%) Ag1906. Run 147697143 | Rel. Exp. (%) Ag2042. Run 165627321 |
|---|---|---|---|---|---|
| Liver adenocarcinoma | 4.5 | 5.8 | Kidney (fetal) | 9.0 | 6.4 |
| Pancreas | 0.7 | 0.8 | Renal ca. 786-0 | 17.9 | 25.7 |
| Pancreatic ca. CAPAN 2 | 3.2 | 8.5 | Renal ca. A498 | 53.6 | 27.0 |
| Adrenal gland | 3.2 | 1.6 | Renal ca. RXF 393 | 9.5 | 46.0 |
| Thyroid | 3.9 | 1.4 | Renal ca. ACHN | 23.0 | 14.7 |
| Salivary gland | 3.3 | 6.2 | Renal ca. UO-31 | 24.1 | 41.8 |
| Pituitary gland | 3.0 | 1.6 | Renal ca. TK-10 | 10.8 | 8.5 |
| Brain (fetal) | 6.7 | 33.7 | Liver | 3.8 | 3.5 |
| Brain (whole) | 26.4 | 92.0 | Liver (fetal) | 4.5 | 0.9 |
| Brain (amygdala) | 17.7 | 37.9 | Liver ca. (hepatoblast) HepG2 | 0.0 | 0.0 |
| Brain (cerebellum) | 9.8 | 94.6 | Lung | 13.3 | 8.8 |
| Brain (hippocampus) | 27.2 | 50.7 | Lung (fetal) | 9.6 | 12.1 |
| Brain (substantia nigra) | 5.0 | 11.6 | Lung ca. (small cell) LX-1 | 1.0 | 2.1 |
| Brain (thalamus) | 16.6 | 51.1 | Lung ca. (small cell) NCI-H69 | 5.8 | 6.1 |
| Cerebral Cortex | 100.0 | 76.3 | Lung ca. (s.cell var.) SHP-77 | 0.2 | 0.0 |
| Spinal cord | 13.4 | 12.0 | Lung ca. (large cell)NCI-H460 | 0.2 | 1.6 |
| glio/astro U87-MG | 39.2 | 28.3 | Lung ca. (non-sm. cell) A549 | 10.7 | 6.4 |

TABLE 31E-continued

Panel 1.3D

| Tissue Name | Rel. Exp. (%) Ag1906. Run 147697143 | Rel. Exp. (%) Ag2042. Run 165627321 | Tissue Name | Rel. Exp. (%) Ag1906. Run 147697143 | Rel. Exp. (%) Ag2042. Run 165627321 |
|---|---|---|---|---|---|
| glio/astro U-118-MG | 54.7 | 100.0 | Lung ca. (non-s.cell) NCI-H23 | 0.1 | 0.4 |
| astrocytoma SW1783 | 2.9 | 3.2 | Lung ca. (non-s.cell) HOP-62 | 0.4 | 0.0 |
| neuro*; met SK-N-AS | 0.5 | 0.3 | Lung ca. (non-s.cl) NCI-H522 | 0.0 | 0.0 |
| astrocytoma SF-539 | 17.9 | 40.9 | Lung ca. (squam.) SW 900 | 8.9 | 12.6 |
| astrocytoma SNB-75 | 20.9 | 12.3 | Lung ca. (squam.) NCI-H596 | 3.3 | 9.0 |
| glioma SNB-19 | 10.4 | 4.1 | Mammary gland | 49.3 | 9.5 |
| glioma U251 | 1.5 | 1.5 | Breast ca.* (pl.ef) MCF-7 | 5.1 | 5.8 |
| glioma SF-295 | 5.3 | 1.4 | Breast ca.* (pl.ef) MDA-MB-231 | 11.0 | 21.9 |
| Heart (fetal) | 34.6 | 6.0 | Breast ca.* (pl.ef) T47D | 0.6 | 0.4 |
| Heart | 12.9 | 12.8 | Breast ca. BT-549 | 0.2 | 0.3 |
| Skeletal muscle (fetal) | 88.9 | 8.5 | Breast ca. MDA-N | 4.7 | 1.3 |
| Skeletal muscle | 6.6 | 6.2 | Ovary | 25.5 | 2.1 |
| Bone marrow | 4.3 | 2.3 | Ovarian ca. OVCAR-3 | 0.5 | 0.0 |
| Thymus | 3.0 | 1.0 | Ovarian ca. OVCAR-4 | 3.2 | 7.6 |
| Spleen | 13.0 | 13.3 | Ovarian ca. OVCAR-5 | 12.1 | 10.2 |
| Lumph node | 6.1 | 5.7 | Ovarian ca. OVCAR-8 | 9.0 | 10.6 |
| Colorectal | 18.4 | 10.5 | Ovarian ca. IGROV-1 | 3.8 | 3.2 |
| Stomach | 9.4 | 5.5 | Ovarian ca.* (ascites) SK-OV-3 | 35.8 | 45.7 |
| Small intestine | 7.7 | 10.2 | Uterus | 5.0 | 8.7 |
| Colon ca. SW480 | 1.3 | 0.3 | Placenta | 17.0 | 4.3 |
| Colon ca.* SW620(SW480 met) | 0.0 | 0.0 | Prostate | 1.7 | 1.3 |
| Colon ca. HT29 | 10.4 | 8.1 | Prostate ca.* (bone met)PC-3 | 18.6 | 22.2 |
| Colon ca. HCT-116 | 0.8 | 2.4 | Testis | 3.6 | 0.8 |
| Colon ca. CaCo-2 | 4.5 | 0.8 | Melanoma Hs688(A).T | 24.7 | 1.4 |
| Colon ca. tissue(ODO3866) | 13.2 | 10.8 | Melanoma* (met) Hs688(B).T | 48.6 | 4.5 |
| Colon ca. HCC-2998 | 4.5 | 2.2 | Melanoma UACC-62 | 2.3 | 3.0 |
| Gastric ca.* (liver met) NCI-N87 | 6.6 | 7.3 | Melanoma M14 | 0.0 | 0.0 |
| Bladder | 0.8 | 1.5 | Melanoma LOX IMVI | 0.5 | 1.4 |
| Trachea | 17.6 | 11.6 | Melanoma* (met) SK-MEL-5 | 0.3 | 0.1 |
| Kidney | 5.3 | 5.1 | Adipose | 20.2 | 9.2 |

TABLE 31F

Panel 2.2

| Tissue Name | Rel. Exp.(%) Ag1906, Run 174153439 | Tissue Name | Rel. Exp.(%) Ag1906, Run 174153439 |
|---|---|---|---|
| Normal Colon | 19.6 | Kidney Margin (OD04348) | 100.0 |
| Colon cancer (OD06064) | 18.2 | Kidney malignant cancer (OD06204B) | 1.2 |
| Colon Margin (OD06064) | 25.9 | Kidney normal adjacent tissue (OD06204E) | 28.9 |

TABLE 31F-continued

Panel 2.2

| Tissue Name | Rel. Exp.(%) Ag1906, Run 174153439 | Tissue Name | Rel. Exp.(%) Ag1906, Run 174153439 |
|---|---|---|---|
| Colon cancer (OD06159) | 7.7 | Kidney Cancer (OD04450-01) | 25.3 |
| Colon Margin (OD06159) | 25.0 | Kidney Margin (OD04450-03) | 20.0 |
| Colon cancer (OD06297-04) | 5.9 | Kidney Cancer 8120613 | 5.1 |
| Colon Margin (OD06297-015) | 41.5 | Kidney Margin 8120614 | 36.1 |
| CC Gr.2 ascend colon (ODO3921) | 6.6 | Kidney Cancer 9010320 | 16.4 |
| CC Margin (ODO3921) | 12.9 | Kidney Margin 9010321 | 22.4 |
| Colon cancer metastasis (OD06104) | 8.2 | Kidney Cancer 8120607 | 98.6 |
| Lung Margin (OD06104) | 11.2 | Kidney Margin 8120608 | 23.2 |
| Colon mets to lung (OD04451-01) | 35.8 | Normal Uterus | 14.6 |
| Lung Margin (OD04451-02) | 38.2 | Uterine Cancer 064011 | 5.5 |
| Normal Prostate | 3.0 | Normal Thyroid | 2.7 |
| Prostate Cancer (OD04410) | 1.3 | Thyroid Cancer 064010 | 1.6 |
| Prostate Margin (OD04410) | 4.6 | Thyroid Cancer A302152 | 8.1 |
| Normal Ovary | 11.2 | Thyroid Margin A302153 | 1.6 |
| Ovarian cancer (OD06283-03) | 1.9 | Normal Breast | 26.4 |
| Ovarian Margin (OD06283-07) | 22.4 | Breast Cancer (OD04566) | 4.1 |
| Ovarian Cancer 064008 | 5.1 | Breast Cancer 1024 | 20.7 |
| Ovarian cancer (OD06145) | 6.4 | Breast Cancer (OD04590-01) | 51.1 |
| Ovarian Margin (OD06145) | 15.0 | Breast Cancer Mets (OD04590-03) | 25.2 |
| Ovarian cancer (OD06455-03) | 5.9 | Breast Cancer Metastasis (OD04655-05) | 9.1 |
| Ovarian Margin (OD06455-07) | 7.1 | Breast Cancer 064006 | 6.4 |
| Normal Lung | 21.2 | Breast Cancer 9100266 | 13.6 |
| Invasive poor diff. lung adeno (ODO4945-01) | 5.0 | Breast Margin 9100265 | 8.4 |
| Lung Margin (OD04945-03) | 16.0 | Breast Cancer A209073 | 4.9 |
| Lung Malignant Cancer (OD03126) | 13.1 | Breast Margin A2090734 | 11.3 |
| Lung Margin (OD03126) | 12.7 | Breast cancer (OD06083) | 22.7 |
| Lung Cancer (OD05014A) | 17.0 | Breast cancer node metastasis (OD06083) | 19.1 |
| Lung Margin (OD05014B) | 40.1 | Normal Liver | 42.6 |
| Lung cancer (OD06081) | 3.8 | Liver Cancer 1026 | 17.4 |
| Lung Margin (OD06081) | 16.8 | Liver Cancer 1025 | 59.0 |
| Lung Cancer (OD04237-01) | 2.7 | Liver Cancer 6004-T | 55.1 |
| Lung Margin (OD04237-02) | 52.1 | Liver Tissue 6004-N | 3.1 |
| Ocular Melanoma Metastasis | 0.4 | Liver Cancer 6005-T | 43.8 |
| Ocular Melanoma Margin (Liver) | 32.5 | Liver Tissue 6005-N | 83.5 |
| Melanoma Metastasis | 1.4 | Liver Cancer 064003 | 17.3 |
| Melanoma Margin (Lung) | 28.9 | Normal Bladder | 3.4 |
| Normal Kidney | 13.2 | Bladder Cancer 1023 | 11.6 |
| Kidney Ca, Nuclear grade 2 (OD04338) | 45.4 | Bladder Cancer A302173 | 2.9 |
| Kidney Margin (OD04338) | 2.8 | Normal Stomach | 34.9 |
| Kidney Ca Nuclear grade 1/2 (OD04339) | 76.8 | Gastric Cancer 9060397 | 9.2 |
| Kidney Margin (OD04339) | 25.5 | Stomach Margin 9060396 | 16.6 |
| Kidney Ca, Clear cell type (OD04340) | 47.6 | Gastric Cancer 9060395 | 21.8 |
| Kidney Margin (OD04340) | 23.3 | Stomach Margin 9060394 | 37.4 |
| Kidney Ca, Nuclear grade 3 (OD04348) | 4.4 | Gastric Cancer 064005 | 10.7 |

TABLE 31G

Panel 2D

| Tissue Name | Rel. Exp.(%) Ag1952, Run 162734662 | Tissue Name | Rel. Exp.(%) Ag1952, Run 162734662 |
|---|---|---|---|
| Normal Colon | 72.2 | Kidney Margin 8120608 | 30.4 |
| CC Well to Mod Diff (ODO3866) | 13.3 | Kidney Cancer 8120613 | 11.8 |
| CC Margin (ODO3866) | 34.9 | Kidney Margin 8120614 | 30.4 |
| CC Gr.2 rectosigmoid (ODO3868) | 8.0 | Kidney Cancer 9010320 | 43.2 |

TABLE 31G-continued

Panel 2D

| Tissue Name | Rel. Exp.(%) Ag1952, Run 162734662 | Tissue Name | Rel. Exp.(%) Ag1952, Run 162734662 |
|---|---|---|---|
| CC Margin (ODO3868) | 5.7 | Kidney Margin 9010321 | 55.1 |
| CC Mod Diff (ODO3920) | 5.4 | Normal Uterus | 4.0 |
| CC Margin (ODO3920) | 22.8 | Uterus Cancer 064011 | 10.1 |
| CC Gr.2 ascend colon (ODO3921) | 35.1 | Normal Thyroid | 9.3 |
| CC Margin (ODO3921) | 38.2 | Thyroid Cancer 064010 | 3.3 |
| CC from Partial Hepatectomy (ODO4309) Mets | 49.7 | Thyroid Cancer A302152 | 5.3 |
| Liver Margin (ODO4309) | 34.9 | Thyroid Margin A302153 | 4.1 |
| Colon mets to lung (OD04451-01) | 6.7 | Normal Breast | 25.3 |
| Lung Margin (OD04451-02) | 34.9 | Breast Cancer (OD04566) | 4.7 |
| Normal Prostate 6546-1 | 60.7 | Breast Cancer (OD04590-01) | 46.0 |
| Prostate Cancer (OD04410) | 6.2 | Breast Cancer Mets (OD04590-03) | 66.9 |
| Prostate Margin (OD04410) | 7.4 | Breast Cancer Metastasis (OD04655-05) | 5.8 |
| Prostate Cancer (OD04720-01) | 6.5 | Breast Cancer 064006 | 5.3 |
| Prostate Margin (OD04720-02) | 19.2 | Breast Cancer 1024 | 20.3 |
| Normal Lung 061010 | 64.6 | Breast Cancer 9100266 | 40.1 |
| Lung Met to Muscle (ODO4286) | 13.6 | Breast Margin 9100265 | 12.9 |
| Muscle Margin (ODO4286) | 22.4 | Breast Cancer A209073 | 28.9 |
| Lung Malignant Cancer (OD03126) | 33.0 | Breast Margin A2090734 | 6.7 |
| Lung Margin (OD03126) | 45.7 | Normal Liver | 26.2 |
| Lung Cancer (OD04404) | 11.4 | Liver Cancer 064003 | 13.9 |
| Lung Margin (OD04404) | 23.8 | Liver Cancer 1025 | 31.4 |
| Lung Cancer (OD04565) | 1.9 | Liver Cancer 1026 | 20.4 |
| Lung Margin (OD04565) | 14.7 | Liver Cancer 6004-T | 42.3 |
| Lung Cancer (OD04237-01) | 5.2 | Liver Tissue 6004-N | 2.5 |
| Lung Margin (OD04237-02) | 40.6 | Liver Cancer 6005-T | 18.8 |
| Ocular Mel Met to Liver (ODO4310) | 1.2 | Liver Tissue 6005-N | 7.7 |
| Liver Margin (ODO4310) | 24.5 | Normal Bladder | 7.6 |
| Melanoma Mets to Lung (OD04321) | 2.1 | Bladder Cancer 1023 | 9.7 |
| Lung Margin (OD04321) | 57.8 | Bladder Cancer A302173 | 2.3 |
| Normal Kidney | 50.3 | Bladder Cancer (OD04718-01) | 17.3 |
| Kidney Ca, Nuclear grade 2 (OD04338) | 13.1 | Bladder Normal Adjacent (OD04718-03) | 17.4 |
| Kidney Margin (OD04338) | 31.0 | Normal Ovary | 4.2 |
| Kidney Ca Nuclear grade 1/2 (OD04339) | 29.5 | Ovarian Cancer 064008 | 6.9 |
| Kidney Margin (OD04339) | 48.0 | Ovarian Cancer (OD04768-07) | 64.2 |
| Kidney Ca, Clear cell type (OD04340) | 100.0 | Ovary Margin (OD04768-08) | 5.0 |
| Kidney Margin (OD04340) | 31.4 | Normal Stomach | 26.8 |
| Kidney Ca, Nuclear grade 3 (OD04348) | 8.0 | Gastric Cancer 9060358 | 7.4 |
| Kidney Margin (OD04348) | 27.0 | Stomach Margin 9060359 | 12.9 |
| Kidney Cancer (OD04622-01) | 71.2 | Gastric Cancer 9060395 | 36.6 |
| Kidney Margin (OD04622-03) | 10.7 | Stomach Margin 9060394 | 28.5 |
| Kidney Cancer (OD04450-01) | 8.2 | Gastric Cancer 9060397 | 42.0 |
| Kidney Margin (OD04450-03) | 25.2 | Stomach Margin 9060396 | 10.7 |
| Kidney Cancer 8120607 | 74.7 | Gastric Cancer 064005 | 35.1 |

TABLE 31H

Panel 4D

| Tissue Name | Rel. Exp.(%) Ag1906, Run 160658067 | Rel. Exp.(%) Ag1952, Run 163578848 | Rel. Exp.(%) Ag1952, Run 163593578 | Rel. Exp.(%) Ag2042, Run 161383006 |
|---|---|---|---|---|
| Secondary Th1 act | 0.3 | 0.2 | 0.2 | 0.3 |
| Secondary Th2 act | 1.1 | 1.8 | 1.1 | 0.7 |
| Secondary Tr1 act | 1.5 | 0.8 | 1.1 | 1.0 |
| Secondary Th1 rest | 0.0 | 0.1 | 0.2 | 0.0 |
| Secondary Th2 rest | 2.5 | 3.6 | 2.4 | 1.5 |

TABLE 31H-continued

Panel 4D

| Tissue Name | Rel. Exp.(%) Ag1906, Run 160658067 | Rel. Exp.(%) Ag1952, Run 163578848 | Rel. Exp.(%) Ag1952, Run 163593578 | Rel. Exp.(%) Ag2042, Run 161383006 |
|---|---|---|---|---|
| Secondary Tr1 rest | 1.1 | 3.3 | 2.3 | 0.9 |
| Primary Th1 act | 0.7 | 0.7 | 0.5 | 0.9 |
| Primary Th2 act | 1.4 | 1.3 | 1.0 | 1.9 |
| Primary Tr1 act | 0.9 | 0.7 | 0.8 | 0.4 |
| Primary Th1 rest | 0.9 | 1.0 | 1.0 | 1.2 |
| Primary Th2 rest | 1.3 | 1.8 | 2.4 | 1.5 |
| Primary Tr1 rest | 0.6 | 0.4 | 0.8 | 0.8 |
| CD45RA CD4 lymphocyte act | 10.2 | 12.9 | 18.0 | 15.3 |
| CD45RO CD4 lymphocyte act | 0.7 | 0.6 | 0.4 | 0.4 |
| CD8 lymphocyte act | 0.8 | 0.5 | 0.4 | 1.2 |
| Secondary CD8 lymphocyte rest | 0.5 | 1.0 | 0.6 | 0.2 |
| Secondary CD8 lymphocyte act | 2.6 | 3.7 | 3.2 | 3.0 |
| CD4 lymphocyte none | 0.1 | 0.2 | 0.3 | 0.1 |
| 2ry Th1/Th2/Tr1_anti-CD95 CH11 | 1.3 | 1.5 | 1.7 | 1.3 |
| LAK cells rest | 10.0 | 9.3 | 9.5 | 3.3 |
| LAK cells IL-2 | 0.2 | 0.3 | 0.2 | 0.2 |
| LAK cells IL-2 + IL-12 | 1.6 | 1.8 | 1.7 | 1.2 |
| LAK cells IL-2 + IFN gamma | 2.8 | 3.8 | 2.8 | 3.2 |
| LAK cells IL-2 + IL-18 | 2.5 | 1.7 | 3.5 | 1.7 |
| LAK cells PMA/ionomycin | 4.8 | 3.3 | 2.9 | 2.1 |
| NK Cells IL-2 rest | 0.1 | 0.2 | 0.3 | 0.0 |
| Two Way MLR 3 day | 10.6 | 15.5 | 13.0 | 7.3 |
| Two Way MLR 5 day | 6.0 | 8.3 | 7.7 | 2.5 |
| Two Way MLR 7 day | 1.9 | 2.7 | 1.7 | 1.3 |
| PBMC rest | 0.8 | 0.5 | 0.7 | 0.4 |
| PBMC PWM | 9.9 | 11.8 | 12.8 | 9.2 |
| PBMC PHA-L | 4.5 | 3.9 | 4.1 | 2.4 |
| Ramos (B cell) none | 0.1 | 0.0 | 0.0 | 0.0 |
| Ramos (B cell) ionomycin | 0.2 | 0.0 | 0.1 | 0.0 |
| B lymphocytes PWM | 10.7 | 10.7 | 11.7 | 10.7 |
| B lymphocytes CD40L and IL-4 | 10.2 | 10.8 | 10.0 | 8.3 |
| EOL-1 dbcAMP | 0.1 | 0.2 | 0.3 | 0.0 |
| EOL-1 dbcAMP PMA/ionomycin | 1.2 | 0.8 | 1.0 | 0.1 |
| Dendritic cells none | 19.5 | 21.8 | 23.3 | 7.3 |
| Dendritic cells LPS | 68.3 | 75.3 | 66.0 | 28.1 |
| Dendritic cells anti-CD40 | 22.8 | 25.3 | 23.5 | 13.0 |
| Monocytes rest | 1.2 | 1.0 | 1.0 | 0.1 |
| Monocytes LPS | 19.8 | 19.9 | 22.7 | 16.5 |
| Macrophages rest | 100.0 | 91.4 | 100.0 | 51.4 |
| Macrophages LPS | 32.1 | 30.6 | 25.2 | 18.0 |
| HUVEC none | 26.6 | 22.8 | 31.2 | 45.1 |
| HUVEC starved | 25.9 | 25.7 | 33.0 | 54.7 |
| HUVEC IL-1beta | 14.9 | 14.1 | 9.9 | 22.8 |
| HUVEC IFN gamma | 10.4 | 11.3 | 11.3 | 17.4 |
| HUVEC TNF alpha + IFN gamma | 40.3 | 51.4 | 46.7 | 59.0 |
| HUVEC TNF alpha + IL4 | 35.8 | 47.0 | 38.7 | 54.0 |
| HUVEC IL-11 | 6.0 | 6.4 | 6.4 | 14.1 |
| Lung Microvascular EC none | 22.5 | 33.0 | 25.5 | 42.0 |
| Lung Microvascular EC TNFalpha + IL-1 beta | 48.6 | 70.7 | 52.5 | 79.6 |
| Microvascular Dermal EC none | 36.3 | 45.1 | 33.7 | 54.3 |
| Microsvasular Dermal EC TNFalpha + IL-1 beta | 46.7 | 79.0 | 54.7 | 54.3 |
| Bronchial epithelium TNFalpha + IL1beta | 4.8 | 48.0 | 3.9 | 7.8 |
| Small airway epithelium none | 10.1 | 14.2 | 7.9 | 12.8 |
| Small airway epithelium TNFalpha + IL-1beta | 33.7 | 40.6 | 42.6 | 41.5 |
| Coronery artery SMC rest | 6.5 | 8.1 | 7.1 | 0.0 |
| Coronery artery SMC TNFalpha + IL-1beta | 5.4 | 7.3 | 9.0 | 7.3 |
| Astrocytes rest | 1.1 | 1.4 | 0.6 | 0.7 |
| Astrocytes TNFalpha + IL-1beta | 5.6 | 7.6 | 6.1 | 3.6 |
| KU-812 (Basophil) rest | 0.1 | 0.2 | 0.3 | 0.0 |
| KU-812 (Basophil) PMA/ionomycin | 0.2 | 0.2 | 0.6 | 0.3 |

TABLE 31H-continued

Panel 4D

| Tissue Name | Rel. Exp.(%) Ag1906, Run 160658067 | Rel. Exp.(%) Ag1952, Run 163578848 | Rel. Exp.(%) Ag1952, Run 163593578 | Rel. Exp.(%) Ag2042, Run 161383006 |
|---|---|---|---|---|
| CCD1106 (Keratinocytes) none | 12.1 | 12.6 | 10.1 | 18.0 |
| CCD1106 (Keratinocytes) TNFalpha + IL-1beta | 0.7 | 9.0 | 1.6 | 1.0 |
| Liver cirrhosis | 2.8 | 5.6 | 3.5 | 3.5 |
| Lupus kidney | 3.2 | 7.0 | 7.6 | 5.4 |
| NCI-H292 none | 9.4 | 10.1 | 11.7 | 16.3 |
| NCI-H292 IL-4 | 10.0 | 11.8 | 14.3 | 24.1 |
| NCI-H292 IL-9 | 11.0 | 16.5 | 16.0 | 23.3 |
| NCI-H292 IL-13 | 7.5 | 12.5 | 8.7 | 11.9 |
| NCI-H292 IFN gamma | 7.9 | 15.0 | 9.6 | 21.9 |
| HPAEC none | 16.2 | 21.0 | 17.0 | 25.7 |
| HPAEC TNF alpha + IL-1beta | 54.3 | 100.0 | 60.3 | 64.6 |
| Lung fibroblast none | 13.9 | 23.0 | 19.8 | 18.8 |
| Lung fibroblast TNF alpha + IL-1 beta | 23.8 | 36.9 | 46.7 | 33.7 |
| Lung fibroblast IL-4 | 27.7 | 43.5 | 32.5 | 29.5 |
| Lung fibroblast IL-9 | 26.8 | 38.4 | 34.4 | 43.2 |
| Lung fibroblast IL-13 | 15.3 | 19.3 | 19.9 | 18.7 |
| Lung fibroblast IFN gamma | 28.5 | 34.4 | 29.9 | 29.1 |
| Dermal fibroblast CCD1070 rest | 47.6 | 69.3 | 55.9 | 64.6 |
| Dermal fibroblast CCD1070 TNF alpha | 53.6 | 60.3 | 69.7 | 100.0 |
| Dermal fibroblast CCD1070 IL-1 beta | 43.8 | 63.3 | 58.6 | 48.0 |
| Dermal fibroblast IFN gamma | 23.5 | 43.5 | 36.3 | 24.0 |
| Dermal fibroblast IL-4 | 39.0 | 58.6 | 59.0 | 41.5 |
| IBD Colitis 2 | 0.2 | 0.5 | 0.2 | 0.4 |
| IBD Crohn's | 1.4 | 1.8 | 1.2 | 1.0 |
| Colon | 14.9 | 32.1 | 29.5 | 18.4 |
| Lung | 38.7 | 55.5 | 59.0 | 44.1 |
| Thymus | 23.0 | 37.6 | 28.3 | 17.2 |
| Kidney | 4.0 | 4.8 | 5.3 | 5.4 |

CNS_neurodegeneration_v1.0 Summary: Ag1952 This panel does not show differential expression of the CG56162-01 gene in Alzheimer's disease. However, this expression profile confirms the presence of this gene in the brain. Please see Panel 1.3D for discussion of this gene in the central nervous system.

Panel 1.3D Summary: Ag1906/Ag2042 The expression of CG56162-01 gene was assessed in two independent runs using 2 different probe/primer pairs, with good concordance between the runs. Highest expression in this panel is seen in brain-derived tissue, including the cerebral cortex and a brain cancer (CTs=25–27). Thus, the expression of this gene could be used to distinguish these samples from other samples in the panel.

This gene encodes a lysophosphase homolog that also has high levels of expression in many of the endocrine/metabolic tissues found on this panel, including adipose, liver, pancreas, pituitary, skeletal muscle and small intestine. Lysophospholipids are detergent-like intermediates in phospholipid metabolism. Lysophospholipases are important enzymes in the regulation of hormone biosynthesis and metabolism, and have been shown to be important in the regulation of insulin secretion (see reference below). Increased lysophospholipids levels have been detected in a variety of diseases including atherosclerosis and hyperlipidemia. In some cases, increased levels of lysophospholipids are hypothesized to result from a dysfunction of lysophospholipids-regulating enzymes including lysophospholipases, which act on biologic membranes to regulate the level of lysophospholipids by hydrolysis. Thus, this gene product may be useful in the treatment of diseases associated with increased lysophospholipids.

This gene also shows high expression in the brain. Lysophospholipases are critical enzymes that regulate brain membrane phospholipids. Alterations in their activity have been associated with a host of neurological disorders, including schizophrenia, Parkinson's, disease, and Alzheimer's disease. Thus, therapeutic modulation of the expression or function of this gene or gene product may be useful in the treatment of these diseases. Please note that results from a third experiment with the probe/primer set Ag1952 are not included. The amp plot indicates that there were experimental difficulties with this run.

References:

Capito K, Reinsmark R, Thams P. Mechanism of fat-induced attenuation of glucose-induced insulin secretion from mouse pancreatic islets. Acta Diabetol 1999 December;36(3):119–25

In order to investigate the mechanism behind fat-induced inhibition of glucose-induced insulin secretion a selection of enzymes that may participate in regulation of pancreatic islet glucose oxidation was studied in islets isolated from mice that had been fed on a laboratory chow diet or on a high-fat diet for 10–12 weeks. At 20 mmol/L glucose production of (14)CO(2) from [U-(14)C]-glucose was decreased 50% in islets from fat-fed mice. At 3.3 mmol/L glucose the glucose oxidation rate was similar in the two groups. The fat-induced decrease in glucose oxidation rate was correlated with a 35% decrease in the maximal glucokinase activity. The K(m) for glucose was unchanged. No differences between the diet groups were found in the activities of hexokinase, phosphofructo-1-kinase, glucose 6-phosphatase or mitochondrial glycerophosphate dehydrogenase. After preincubation with 20 mmol/L glucose the activity of cytosolic Ca(2+)-independent as well as Ca(2+)-dependent phospholipase A(2) was unchanged by fat-feeding. However, the activity of lysophospholipase was significantly increased by fat feeding, which may result in lowered concentrations of islet lysophosphatidylcholine (lysoPC). It is concluded that in fat-induced diabetic animals a decrease in islet glucokinase may contribute considerably to the decrease in islet glucose oxidation rate. Furthermore, the study raises the possibility that changes in islet lysoPC may contribute to the fat-induced attenuation of glucose-induced insulin secretion.

PMID: 10664315

Ross B M, Turenne S, Moszczynska A, Warsh J J, Kish S J. Differential alteration of phospholipase A2 activities in brain of patients with schizophrenia. Brain Res 1999 Mar. 13;821(2):407–13

We recently reported that the activity of a calcium-independent subtype of phospholipase A2 is increased in blood of patients with schizophrenia. The present investigation examined whether similar changes take place in brain of patients with this disorder, and for comparison, in patients with bipolar disorder. The activity of two classes of PLA2, calcium-stimulated and independent, were assayed in autopsied temporal, prefrontal and occipital cortices, putamen, hippocampus and thalamus of 10 patients with schizophrenia, 8 patients with bipolar disorder and 12 matched control subjects. Calcium-independent PLA2 activity was increased by 45% in the temporal cortex of patients with schizophrenia as compared with the controls but was not significantly altered in other brain areas. In contrast, calcium-stimulated PLA2 activity was decreased by 27–42% in the temporal and prefrontal cortices and putamen, with no significant alterations in other brain regions. Brain PLA2 activity was normal in patients with bipolar disorder. Calcium-stimulated PLA2 activity was normal in cortex, cerebellum and striatum of rats treated acutely or chronically with haloperidol, whereas calcium-independent PLA2 activity was decreased in striatum of chronically treated animals, indicating that altered PLA2 activity in patients with schizophrenia is unlikely to be a direct effect of medication. Studies of the cellular role played by PLA2 suggest that decreased calcium-stimulated PLA2 activity, as also occurs in striatum of chronic human cocaine users, may be due, in part, to increased dopaminergic activity in the disorder, whereas increased calcium-independent PLA2 activity may be related to abnormal fatty acid metabolism and oxidative stress in schizophrenia. Copyright 1999 Elsevier Science B.V.

Ross B M, Moszczynska A, Erlich J, Kish S J. Low activity of key phospholipid catabolic and anabolic enzymes in human substantia nigra: possible implications for Parkinson's disease. Neuroscience 1998 April;83(3):791–8

To determine whether increased oxidative stress in substantia nigra of patients with idiopathic Parkinson's disease might be related to decreased ability of nigral cells to detoxify oxidized membrane phospholipids, we compared levels of the major phospholipid metabolizing enzymes in autopsied substantia nigra with those in non-nigral (n=11) brain areas of the normal human brain. Whereas most enzymes possessed a relatively homogeneous distribution, the activity of the major phospholipid catabolizing enzyme phospholipase A2, assayed in the presence of calcium ions, varied amongst different regions, with substantia nigra possessing the lowest activity. Similarly, calcium-independent phospholipase A2 activity, although possessing a relatively homogeneous regional distribution, was also low in the substantia nigra. This, coupled with low activity of phosphoethanolamine- and phosphocholine-cytidylyltransferases, major regulatory enzymes of phospholipid synthesis, in this brain region, suggest that the rate of phospholipid turnover is low in the substantia nigra. Low activity of key phospholipid catabolic and anabolic enzymes in human substantia nigra might result in reduced ability to repair oxidative membrane damage, as may occur in Parkinson's disease.

PMID: 9483562

Ross B M, Moszczynska A, Erlich J, Kish S J. Phospholipid-metabolizing enzymes in Alzheimer's disease: increased lysophospholipid acyltransferase activity and decreased phospholipase A2 activity. J Neurochem 1998 February;70(2):786–93

Damage to brain membrane phospholipids may play an important role in the pathogenesis of Alzheimer's disease (AD); however, the critical metabolic processes responsible for the generation and repair of membrane phospholipids affected by the disease are unknown. We measured the activity of key phospholipid catabolic and anabolic enzymes in morphologically affected and spared areas of autopsied brain of patients with AD and in matched control subjects. The activity of the major catabolic enzyme phospholipase A2 (PLA2), measured in both the presence and absence of Ca2+, was significantly decreased (−35 to −53%) in parietal and temporal cortices of patients with AD. In contrast, the activities of lysophospholipid acyltransferase, which recycles lysophospholipids into intact phospholipids, and glycerophosphocholine phosphodiesterase, which returns phospholipid catabolites to be used in phospholipid resynthesis, were increased by approximately 50–70% in the same brain areas. Brain activities of enzymes involved in de novo phospholipid synthesis (ethanolamine kinase, choline kinase, choline phosphotransferase, phosphoethanolamine cytidylyltransferase, and phosphocholine cytidylyltransferase) were either normal or only slightly altered. The activities of PLA2 and acyltransferase were normal in the degenerating cerebellum of patients with spinocerebellar atrophy type 1, whereas the activity of glycerophosphocholine phosphodiesterase was reduced, suggesting that the alterations in AD brain were not non-specific consequences of neurodegeneration. Our data suggest that compensatory phospholipid metabolic changes are present in AD brain that reduce the rate of phospholipid loss via both decreased catabolism (PLA2) and increased phospholipid resynthesis (acyltransferase and glycerophosphocholine phosphodiesterase).

PMID: 9453575

Panel 2.2 Summary: Ag1906 The expression of the CG56162-01 gene appears to be highest in a sample derived from normal kidney tissue (CT=28.1). In addition, there is substantial expression associated with kidney cancer tissue, liver cancer tissue, breast cancer tissue and colon cancer tissue. Thus, the expression of this gene could be used to distinguish this normal kidney tissue sample from other samples in the panel. Moreover, therapeutic modulation of thie gene, through the use of antibodies, small molecule drugs or protein therapeutics might be beneficial in the treatment of kidney cancer, liver cancer, breast cancer or colon cancer.

Panel 2D Summary: Ag1952 The expression of the CG56162-01 gene appears to be highest in a sample derived from kidney cancer tissue (CT=26.1). In addition, there is substantial expression associated with other samples of kidney cancer tissue, liver cancer tissue, breast cancer tissue, colon cancer tissue, normal prostate and normal lung. Thus, the expression of this gene could be used to distinguish this kidney cancer tissue sample from other samples in the panel. Moreover, therapeutic modulation of thie gene, through the use of antibodies, small molecule drugs or protein therapeutics might be beneficial in the treatment of kidney cancer, liver cancer, breast cancer or colon cancer.

Panel 4D Summary: Ag1906/Ag1952/Ag2042 The expression of CG56162-01 gene was assessed in three independent runs using three different probe/primer pairs, with good concordance between the runs. This gene is expressed at moderate levels in a wide variety of cells including resting macrophages, TNF-alpha-activated dermal fibroblasts, LPS-stimulated dendritic cells, TNF-alpha+IL-1-beta-activated pulmonary artery endothelial cells, TNF-alpha+IL-1-beta-activated lung microvascular cells, and TNF-alpha+IFN-gamma-activated umbilical vein endothelial cells. Thus, sntibodies and small molecules that antagonize the function of the CG120803-01 geen productimay be useful to reduce or eliminate the symptoms in patients with inflammatory and autoimmune diseases, such as lupus erythematosus, asthma, emphysema, Crohn's disease, ulcerative colitis, multiple sclerosis, rheumatoid arthritis, osteoarthritis, and psoriasis.

SEC10 (CG56164-01)

Expression of gene CG56164-01 was assessed using the primer-probe set Ag1677, described in Table 32A. Results of the RTQ-PCR runs are shown in Tables 32B, 32C, 23D, 32E and 32F.

TABLE 32A

PROBE NAME Ag1677

| Primers | Sequences | | Length | Start Position |
|---|---|---|---|---|
| Forward | 5'-cccattcagcttcacagaga-3' | (SEQ ID NO:189) | 20 | 767 |
| Probe | TET-5'-cagatcctggcattctctcagaagctg-3'-TAMRA | (SEQ ID NO:190) | 27 | 788 |
| Reverse | 5'-atgctcactgtctgttccttgt-3' | (SEQ ID NO:191) | 22 | 822 |

TABLE 32B

CNS_neurodegeneration_v1.0

| Tissue Name | Rel. Exp.(%) Ag1677, Run 209733901 | Tissue Name | Rel. Exp.(%) Ag1677, Run 209733901 |
|---|---|---|---|
| AD 1 Hippo | 9.9 | Control (Path) 3 Temporal Ctx | 8.2 |
| AD 2 Hippo | 16.7 | Control (Path) 4 Temporal Ctx | 75.8 |
| AD 3 Hippo | 5.3 | AD 1 Occipital Ctx | 14.4 |
| AD 4 Hippo | 26.2 | AD 2 Occipital Ctx (Missing) | 2.5 |
| AD 5 Hippo | 40.6 | AD 3 Occipital Ctx | 5.9 |
| AD 6 Hippo | 15.6 | AD 4 Occipital Ctx | 48.6 |
| Control 2 Hippo | 19.9 | AD 5 Occipital Ctx | 20.3 |
| Control 4 Hippo | 21.8 | AD 6 Occipital Ctx | 19.3 |
| Control (Path) 3 Hippo | 8.5 | Control 1 Occipital Ctx | 11.4 |
| AD 1 Temporal Ctx | 8.7 | Control 2 Occipital Ctx | 25.7 |
| AD 2 Temporal Ctx | 75.3 | Control 3 Occipital Ctx | 18.0 |
| AD 3 Temporal Ctx | 5.1 | Control 4 Occipital Ctx | 9.3 |
| AD 4 Temporal Ctx | 92.0 | Control (Path) 1 Occipital Ctx | 46.0 |
| AD 5 Inf Temporal Ctx | 100.0 | Control (Path) 2 Occipital Ctx | 48.0 |
| AD 5 Sup Temporal Ctx | 37.9 | Control (Path) 3 Occipital Ctx | 4.2 |
| AD 6 Inf Temporal Ctx | 19.5 | Control (Path) 4 Occipital Ctx | 7.8 |
| AD 6 Sup Temporal Ctx | 15.7 | Control 1 Parietal Ctx | 26.6 |
| Control 1 Temporal Ctx | 11.7 | Control 2 Parietal Ctx | 16.0 |
| Control 2 Temporal Ctx | 21.6 | Control 3 Parietal Ctx | 30.4 |
| Control 3 Temporal Ctx | 17.1 | Control (Path) 1 Parietal Ctx | 24.0 |
| Control 3 Temporal Ctx | 25.3 | Control (Path) 2 Parietal Ctx | 47.3 |
| Control (Path) 1 Temporal Ctx | 70.7 | Control (Path) 3 Parietal Ctx | 4.5 |
| Control (Path) 2 Temporal Ctx | 56.3 | Control (Path) 4 Parietal Ctx | 15.7 |

TABLE 32C

General_screening_panel_v1.4

| Tissue Name | Rel. Exp.(%) Ag1677, Run 208021859 | Tissue Name | Rel. Exp.(%) Ag1677, Run 208021859 |
|---|---|---|---|
| Adipose | 21.3 | Renal ca.TK-10 | 0.6 |
| Melanoma* Hs688(A).T | 0.3 | Bladder | 6.3 |
| Melanoma* Hs688(B).T | 0.1 | Gastric ca. (liver met.) NCI-N87 | 0.2 |
| Melanoma* M14 | 0.1 | Gastric ca. KATO III | 0.1 |
| Melanoma* LOXIMVI | 0.2 | Colon ca. SW-948 | 0.3 |
| Melanoma* SK-MEL-5 | 0.7 | Colon ca. SW480 | 0.2 |
| Squamous cell carcinoma SCC-4 | 0.2 | Colon ca.* (SW480 met) SW620 | 0.4 |
| Testis Pool | 4.7 | Colon ca. HT29 | 1.3 |
| Prostate ca.* (bone met) PC-3 | 0.3 | Colon ca. HCT-116 | 0.4 |
| Prostate Pool | 3.0 | Colon ca. CaCo-2 | 3.5 |
| Placenta | 6.3 | Colon cancer tissue | 1.9 |
| Uterus Pool | 2.0 | Colon ca. SW1116 | 0.6 |
| Ovarian ca. OVCAR-3 | 0.2 | Colon ca. Colo-205 | 0.4 |
| Ovarian ca. SK-OV-3 | 0.2 | Colon ca. SW-48 | 0.4 |
| Ovarian ca. OVCAR-4 | 0.3 | Colon Pool | 6.2 |
| Ovarian ca. OVCAR-5 | 0.3 | Small Intestine Pool | 3.8 |
| Ovarian ca. IGROV-1 | 0.6 | Stomach Pool | 3.8 |
| Ovarian ca. OVCAR-8 | 0.8 | Bone Marrow Pool | 1.8 |
| Ovary | 1.8 | Fetal Heart | 19.1 |
| Breast ca. MCF-7 | 24.0 | Heart Pool | 21.0 |
| Breast ca. MDA-MB-231 | 0.4 | Lymph Node Pool | 4.7 |
| Breast ca. BT 549 | 23.8 | Fetal Skeletal Muscle | 4.4 |
| Breast ca T47D | 0.7 | Skeletal Muscle Pool | 14.0 |
| Breast ca. MDA-N | 0.7 | Spleen Pool | 2.5 |
| Breast Pool | 3.6 | Thymus Pool | 3.3 |
| Trachea | 2.7 | CNS cancer (glio/astro) U87-MG | 0.1 |
| Lung | 2.9 | CNS cancer (glio/astro) U118-MG | 1.0 |
| Fetal Lung | 82.4 | CNS cancer (neuro;met) SK-N-AS | 0.1 |
| Lung ca. NCI-N417 | 0.1 | CNS cancer (astro) SF-539 | 0.2 |
| Lung ca. LX-1 | 0.2 | CNS cancer (astro) SNB-75 | 0.7 |
| Lung ca. NCI-H146 | 0.2 | CNS cancer (glio) SNB-19 | 1.3 |
| Lung ca. SHP-77 | 31.6 | CNS cancer (glio) SF-295 | 0.2 |
| Lung ca. A549 | 0.9 | Brain (Amygdala) Pool | 12.1 |
| Lung ca. NCI-H526 | 0.5 | Brain (cerebellum) | 100.0 |
| Lung ca. NCI-H23 | 0.3 | Brain (fetal) | 3.0 |
| Lung ca. NCI-H460 | 0.2 | Brain (Hippocampus) Pool | 8.4 |
| Lung ca. HOP-62 | 0.2 | Cerebral Cortex Pool | 21.2 |
| Lung ca. NCI-H522 | 0.0 | Brain (Substantia nigra) Pool | 22.7 |
| Liver | 0.4 | Brain (Thalamus) Pool | 14.5 |
| Fetal Liver | 0.7 | Brain (whole) | 22.1 |
| Liver ca. HepG2 | 0.3 | Spinal Cord Pool | 5.3 |
| Kidney Pool | 14.8 | Adrenal Gland | 2.9 |
| Fetal Kidney | 19.6 | Pituitary gland Pool | 10.4 |
| Renal ca. 786-0 | 0.4 | Salivary Gland | 5.1 |
| Renal ca. A498 | 0.5 | Thyroid (female) | 39.5 |
| Renal ca. ACHN | 0.2 | Pancreatic ca. CAPAN2 | 0.4 |
| Renal ca. UO-31 | 0.2 | Pancreas Pool | 6.1 |

TABLE 32D

Panel 1.3D

| Tissue Name | Rel. Exp. (%) Ag1677, Run 152171910 | Rel. Exp. (%) Ag1677, Run 165532764 | Tissue Name | Rel. Exp. (%) Ag1677, Run 152171910 | Rel. Exp. (%) Ag1677, Run 165532764 |
|---|---|---|---|---|---|
| Liver adenocarcinoma | 0.0 | 0.1 | Kidney (fetal) | 1.9 | 7.0 |
| Pancreas | 14.8 | 23.5 | Renal ca. 786-0 | 0.0 | 0.0 |
| Pancreatic ca. CAPAN 2 | 0.0 | 0.1 | Renal ca. A498 | 0.0 | 0.2 |
| Adrenal gland | 2.1 | 3.3 | Renal ca. RXF 393 | 0.0 | 1.0 |
| Thyroid | 36.1 | 37.1 | Renal ca. ACHN | 0.0 | 0.5 |

TABLE 32D-continued

Panel 1.3D

| Tissue Name | Rel. Exp. (%) Ag1677, Run 152171910 | Rel. Exp. (%) Ag1677, Run 165532764 | Tissue Name | Rel. Exp. (%) Ag1677, Run 152171910 | Rel. Exp. (%) Ag1677, Run 165532764 |
|---|---|---|---|---|---|
| Salivary gland | 3.2 | 10.0 | Renal ca. UO-31 | 0.0 | 0.0 |
| Pituitary gland | 6.4 | 10.4 | Renal ca. TK-10 | 0.0 | 0.3 |
| Brain (fetal) | 0.8 | 1.6 | Liver | 0.0 | 0.9 |
| Brain (whole) | 13.2 | 36.6 | Liver (fetal) | 0.0 | 1.9 |
| Brain (amygdala) | 4.6 | 17.9 | Liver ca. (hepatoblast) HepG2 | 0.0 | 0.0 |
| Brain (cerebellum) | 11.1 | 74.2 | Lung | 100.0 | 100.0 |
| Brain (hippocampus) | 23.8 | 30.6 | Lung (fetal) | 59.5 | 72.2 |
| Brain (substantia nigra) | 4.6 | 18.7 | Lung ca. (small cell) LX-1 | 0.0 | 1.1 |
| Brain (thalamus) | 3.5 | 20.2 | Lung ca. (small cell) NCI-H69 | 0.0 | 0.2 |
| Cerebral Cortex | 22.4 | 28.3 | Lung ca. (s.cell var.) SHP-77 | 0.0 | 0.7 |
| Spinal cord | 0.9 | 6.9 | Lung ca. (large cell)NCI-H460 | 0.0 | 0.7 |
| glio/astro U87-MG | 0.0 | 0.1 | Lung ca. (non-sm. cell) A549 | 0.0 | 0.9 |
| glio/astro U-118-MG | 0.0 | 2.2 | Lung ca. (non-s.cell) NCI-H23 | 0.2 | 1.0 |
| astrocytoma SW1783 | 0.0 | 0.7 | Lung ca. (non-s.cell) HOP-62 | 0.0 | 0.3 |
| neuro*; met SK-N-AS | 0.0 | 0.5 | Lung ca. (non-s.cl) NCI-H522 | 0.0 | 0.8 |
| astrocytoma SF-539 | 0.1 | 0.7 | Lung ca. (squam.) SW 900 | 0.0 | 0.7 |
| astrocytoma SNB-75 | 0.0 | 1.0 | Lung ca. (squam.) NCI-H596 | 0.0 | 0.6 |
| glioma SNB-19 | 0.0 | 1.0 | Mammary gland | 16.7 | 19.5 |
| glioma U251 | 0.0 | 1.1 | Breast ca.* (pl.ef) MCF-7 | 3.8 | 5.3 |
| glioma SF-295 | 0.0 | 1.2 | Breast ca.* (pl.ef) MDA-MB-231 | 0.0 | 0.2 |
| Heart (fetal) | 55.5 | 40.6 | Breast ca.* (pl.ef) T47D | 0.0 | 0.7 |
| Heart | 11.9 | 47.0 | Breast ca. BT-549 | 0.4 | 2.2 |
| Skeletal muscle (fetal) | 41.2 | 22.7 | Breast ca. MDA-N | 0.0 | 0.9 |
| Skeletal muscle | 2.0 | 22.4 | Ovary | 3.5 | 3.1 |
| Bone marrow | 4.8 | 12.1 | Ovarian ca. OVCAR-3 | 0.0 | 1.3 |
| Thymus | 0.4 | 1.9 | Ovarian ca. OVCAR-4 | 0.0 | 0.0 |
| Spleen | 2.3 | 3.2 | Ovarian ca. OVCAR-5 | 0.0 | 0.6 |
| Lymph node | 4.2 | 15.7 | Ovarian ca. OVCAR-8 | 0.0 | 1.4 |
| Colorectal | 57.4 | 64.2 | Ovarian ca. IGROV-1 | 0.0 | 0.3 |
| Stomach | 11.6 | 20.9 | Ovarian ca.* (ascites) SK-OV-3 | 0.0 | 0.7 |
| Small intestine | 4.0 | 7.5 | Uterus | 2.5 | 19.6 |
| Colon ca. SW480 | 0.0 | 0.1 | Placenta | 3.7 | 4.3 |
| Colon ca.* SW620(SW480 met) | 0.0 | 0.2 | Prostate | 4.5 | 8.4 |
| Colon ca. HT29 | 0.0 | 0.2 | Prostate ca.* (bone met)PC-3 | 0.0 | 0.2 |
| Colon ca. HCT-116 | 0.0 | 0.9 | Testis | 0.5 | 3.2 |
| Colon ca. CaCo-2 | 0.4 | 1.5 | Melanoma Hs688(A).T | 0.0 | 0.7 |
| Colon ca. tissue(ODO3866) | 0.9 | 3.0 | Melanoma* (met) Hs688(B).T | 0.0 | 0.0 |
| Colon ca. HCC-2998 | 0.5 | 2.4 | Melanoma UACC-62 | 0.0 | 0.4 |
| Gastric ca.* (liver met) NCI-N87 | 0.0 | 0.6 | Melanoma M14 | 0.0 | 0.2 |
| Bladder | 0.0 | 2.7 | Melanoma LOX IMVI | 0.0 | 0.6 |

TABLE 32D-continued

Panel 1.3D

| Tissue Name | Rel. Exp. (%) Ag1677, Run 152171910 | Rel. Exp. (%) Ag1677, Run 165532764 | Tissue Name | Rel. Exp. (%) Ag1677, Run 152171910 | Rel. Exp. (%) Ag1677, Run 165532764 |
|---|---|---|---|---|---|
| Trachea | 2.4 | 6.6 | Melanoma* (met) SK-MEL-5 | 0.0 | 0.6 |
| Kidney | 9.6 | 37.9 | Adipose | 7.2 | 15.3 |

TABLE 32E

Panel 2D

| Tissue Name | Rel. Exp.(%) Ag1677, Run 152570595 | Tissue Name | Rel. Exp.(%) Ag1677, Run 152570595 |
|---|---|---|---|
| Normal Colon | 63.3 | Kidney Margin 8120608 | 26.6 |
| CC Well to Mod Diff (ODO3866) | 0.5 | Kidney Cancer 8120613 | 2.3 |
| CC Margin (ODO3866) | 77.9 | Kidney Margin 8120614 | 50.0 |
| CC Gr.2 rectosigmoid (ODO3868) | 5.3 | Kidney Cancer 9010320 | 0.7 |
| CC Margin (ODO3868) | 2.2 | Kidney Margin 9010321 | 26.2 |
| CC Mod Diff (ODO3920) | 29.5 | Normal Uterus | 0.6 |
| CC Margin (ODO3920) | 100.0 | Uterus Cancer 064011 | 1.9 |
| CC Gr.2 ascend colon (ODO3921) | 30.6 | Normal Thyroid | 21.9 |
| CC Margin (ODO3921) | 42.9 | Thyroid Cancer 064010 | 0.6 |
| CC from Partial Hepatectomy (ODO4309) Mets | 1.0 | Thyroid Cancer A302152 | 1.1 |
| Liver Margin (ODO4309) | 0.0 | Thyroid Margin A302153 | 14.5 |
| Colon mets to lung (OD04451-01) | 1.5 | Normal Breast | 6.6 |
| Lung Margin (OD04451-02) | 15.5 | Breast Cancer (OD04566) | 0.1 |
| Normal Prostate 6546-1 | 3.3 | Breast Cancer (OD04590-01) | 0.6 |
| Prostate Cancer (OD04410) | 1.8 | Breast Cancer Mets (OD04590-03) | 5.1 |
| Prostate Margin (OD04410) | 1.4 | Breast Cancer Metastasis (OD04655-05) | 0.7 |
| Prostate Cancer (OD04720-01) | 0.5 | Breast Cancer 064006 | 0.1 |
| Prostate Margin (OD04720-02) | 1.3 | Breast Cancer 1024 | 5.6 |
| Normal Lung 061010 | 36.3 | Breast Cancer 9100266 | 0.3 |
| Lung Met to Muscle (ODO4286) | 0.1 | Breast Margin 9100265 | 0.7 |
| Muscle Margin (ODO4286) | 2.7 | Breast Cancer A209073 | 0.3 |
| Lung Malignant Cancer (OD03126) | 6.1 | Breast Margin A2090734 | 1.3 |
| Lung Margin (OD03126) | 63.7 | Normal Liver | 0.0 |
| Lung Cancer (OD04404) | 3.5 | Liver Cancer 064003 | 0.1 |
| Lung Margin (OD04404) | 17.3 | Liver Cancer 1025 | 0.0 |
| Lung Cancer (OD04565) | 0.0 | Liver Cancer 1026 | 0.0 |
| Lung Margin (OD04565) | 21.3 | Liver Cancer 6004-T | 0.2 |
| Lung Cancer (OD04237-01) | 0.2 | Liver Tissue 6004-N | 0.0 |
| Lung Margin (OD04237-02) | 17.9 | Liver Cancer 6005-T | 0.2 |
| Ocular Mel Met to Liver (ODO4310) | 0.1 | Liver Tissue 6005-N | 0.0 |
| Liver Margin (ODO4310) | 0.0 | Normal Bladder | 1.3 |
| Melanoma Mets to Lung (OD04321) | 0.1 | Bladder Cancer 1023 | 0.0 |
| Lung Margin (OD04321) | 33.9 | Bladder Cancer A302173 | 0.0 |
| Normal Kidney | 18.4 | Bladder Cancer (OD04718-01) | 0.2 |
| Kidney Ca, Nuclear grade 2 (OD04338) | 0.8 | Bladder Normal Adjacent (OD04718-03) | 0.6 |
| Kidney Margin (OD04338) | 19.3 | Normal Ovary | 2.3 |
| Kidney Ca Nuclear grade 1/2 (OD04339) | 0.1 | Ovarian Cancer 064008 | 0.0 |
| Kidney Margin (OD04339) | 50.7 | Ovarian Cancer (OD04768-07) | 0.6 |
| Kidney Ca, Clear cell type (OD04340) | 14.9 | Ovary Margin (OD04768-08) | 0.1 |
| Kidney Margin (OD04340) | 34.4 | Normal Stomach | 1.9 |
| Kidney Ca, Nuclear grade 3 (OD04348) | 0.3 | Gastric Cancer 9060358 | 0.2 |
| Kidney Margin (OD04348) | 13.9 | Stomach Margin 9060359 | 0.8 |
| Kidney Cancer (OD04622-01) | 0.2 | Gastric Cancer 9060395 | 0.1 |

TABLE 32E-continued

Panel 2D

| Tissue Name | Rel. Exp.(%) Ag1677, Run 152570595 | Tissue Name | Rel. Exp.(%) Ag1677, Run 152570595 |
|---|---|---|---|
| Kidney Margin (OD04622-03) | 4.8 | Stomach Margin 9060394 | 1.2 |
| Kidney Cancer (OD04450-01) | 0.0 | Gastric Cancer 9060397 | 3.9 |
| Kidney Margin (OD04450-03) | 15.0 | Stomach Margin 9060396 | 0.5 |
| Kidney Cancer 8120607 | 0.1 | Gastric Cancer 064005 | 0.1 |

TABLE 32F

Panel 4D

| Tissue Name | Rel. Exp.(%) Ag1677, Run 152571252 | Tissue Name | Rel. Exp.(%) Ag1677, Run 152571252 |
|---|---|---|---|
| Secondary Th1 act | 0.0 | HUVEC IL-1beta | 0.0 |
| Secondary Th2 act | 0.0 | HUVEC IFN gamma | 0.0 |
| Secondary Tr1 act | 0.0 | HUVEC TNF alpha + IFN gamma | 0.0 |
| Secondary Th1 rest | 0.0 | HUVEC TNF alpha + IL4 | 0.0 |
| Secondary Th2 rest | 0.0 | HUVEC IL-11 | 1.0 |
| Secondary Tr1 rest | 0.0 | Lung Microvascular EC none | 0.0 |
| Primary Th1 act | 0.0 | Lung Microvascular EC TNFalpha + IL-1beta | 0.0 |
| Primary Th2 act | 0.0 | Microvascular Dermal EC none | 0.5 |
| Primary Tr1 act | 0.0 | Microvascular Dermal EC TNFalpha + IL-1beta | 0.0 |
| Primary Th1 rest | 0.0 | Bronchial epithelium TNFalpha + IL1beta | 0.0 |
| Primary Th2 rest | 0.0 | Small airway epithelium none | 0.0 |
| Primary Tr1 rest | 0.0 | Small airway epithelium TNFalpha + IL-1beta | 0.0 |
| CD45RA CD4 lymphocyte act | 0.0 | Coronery artery SMC rest | 0.0 |
| CD45RO CD4 lymphocyte act | 0.0 | Coronery artery SMC TNFalpha + IL-1beta | 0.0 |
| CD8 lymphocyte act | 0.0 | Astrocytes rest | 0.0 |
| Secondary CD8 lymphocyte rest | 0.0 | Astrocytes TNFalpha + IL-1beta | 0.8 |
| Secondary CD8 lymphocyte act | 0.0 | KU-812 (Basophil) rest | 1.4 |
| CD4 lymphocyte none | 0.0 | KU-812 (Basophil) PMA/ionomycin | 0.0 |
| 2ry Th1/Th2/Tr1_anti-CD95 CH11 | 0.0 | CCD1106 (Keratinocytes) none | 0.0 |
| LAK cells rest | 0.0 | CCD1106 (Keratinocytes) TNFalpha + IL-1beta | 0.0 |
| LAK cells IL-2 | 0.0 | Liver cirrhosis | 0.0 |
| LAK cells IL-2 + IL-12 | 0.0 | Lupus kidney | 10.5 |
| LAK cells IL-2 + IFN gamma | 0.4 | NCI-H292 none | 0.0 |
| LAK cells IL-2 + IL-18 | 0.0 | NCI-H292 IL-4 | 0.0 |
| LAK cells PMA/ionomycin | 0.0 | NCI-H292 IL-9 | 0.0 |
| NK Cells IL-2 rest | 0.0 | NCI-H292 IL-13 | 0.0 |
| Two Way MLR 3 day | 0.0 | NCI-H292 IFN gamma | 0.0 |
| Two Way MLR 5 day | 0.0 | HPAEC none | 0.0 |
| Two Way MLR 7 day | 0.0 | HPAEC TNF alpha + IL-1 beta | 0.0 |
| PBMC rest | 0.0 | Lung fibroblast none | 0.0 |
| PBMC PWM | 0.0 | Lung fibroblast TNF alpha + IL-1 beta | 0.0 |
| PBMC PHA-L | 0.0 | Lung fibroblast IL-4 | 0.0 |
| Ramos (B cell) none | 0.8 | Lung fibroblast IL-9 | 0.0 |
| Ramos (B cell) ionomycin | 0.4 | Lung fibroblast IL-13 | 0.0 |
| B lymphocytes PWM | 0.0 | Lung fibroblast IFN gamma | 0.0 |
| B lymphocytes CD40L and IL-4 | 0.0 | Dermal fibroblast CCD1070 rest | 0.0 |
| EOL-1 dbcAMP | 0.0 | Dermal fibroblast CCD1070 TNF alpha | 0.0 |
| EOL-1 dbcAMP PMA/ionomycin | 0.0 | Dermal fibroblast CCD1070 IL-1 beta | 0.0 |
| Dendritic cells none | 0.0 | Dermal fibroblast IFN gamma | 0.0 |
| Dendritic cells LPS | 0.0 | Dermal fibroblast IL-4 | 5.8 |
| Dendritic cells anti-CD40 | 0.0 | IBD Colitis 2 | 0.5 |

TABLE 32F-continued

Panel 4D

| Tissue Name | Rel. Exp.(%) Ag1677, Run 152571252 | Tissue Name | Rel. Exp.(%) Ag1677, Run 152571252 |
|---|---|---|---|
| Monocytes rest | 0.0 | IBD Crohn's | 0.0 |
| Monocytes LPS | 0.0 | Colon | 9.7 |
| Macrophages rest | 0.0 | Lung | 14.1 |
| Macrophages LPS | 0.0 | Thymus | 100.0 |
| HUVEC none | 0.0 | Kidney | 3.9 |
| HUVEC starved | 0.0 | | |

CNS_neurodegeneration_v1.0 Summary: Ag1677 No change of expression of the CG56164-01 gene is noted in Alzheimer's disease, consistent with the scientific literature.

However, this panel does confirm expression of this gene in the brain. Please see Panel 1.3D for discussion of utility of this gene in the central nervous system.

References:

Vlkolinsky R, Cairns N, Fountoulakis M, Lubec G. Decreased brain levels of 2',3'-cyclic nucleotide-3'-phosphodiesterase in Down syndrome and Alzheimer's disease. Neurobiol Aging 2001 July–August;22(4):547–53

In Down syndrome (DS) as well as in Alzheimer's disease (AD) oligodendroglial and myelin alterations have been reported. 2',3'-cyclic nucleotide-3'-phosphodiesterase (CNPase) and carbonic anhydrase TI (CA II) are widely accepted as markers for oligodendroglia and myelin. However, only data on CNPase activity have been available in AD and DS brains so far. In our study we determined the protein levels of CNPase and CA II in DS, AD and in control post mortem brain samples in order to assess oligodendroglia and myelin alterations in both diseases. We used two dimensional electrophoresis to separate brain proteins that were subsequently identified by matrix assisted laser desorption and ionization mass-spectroscopy (MALDI-MS). Seven brain areas were investigated (frontal, temporal, occipital and parietal cortex, cerebellum, thalamus and caudate nucleus). In comparison to control brains we detected significantly decreased CNPase protein levels in frontal and temporal cortex of DS patients. The level of CA II protein in DS was unchanged in comparison to controls. In AD brains levels of CNPase were decreased in frontal cortex only. The level of CA II in all brain areas in AD group was comparable to controls. Changes of CNPase protein levels in DS and AD are in agreement with the previous finding of decreased CNPase activity in DS and AD brain. They probably reflect decreased oligodendroglial density and/or reduced myelination. These can be secondary to disturbances in axon/oligodendroglial communication due to neuronal loss present in both diseases. Alternatively, reduced CNPase levels in DS brains may be caused by impairment of glucose metabolism and/or alterations of thyroid functions.

General_screening_panel_v1.4 Summary: Ag1677 Highest expression of the CG56164-01 gene in this panel is seen in the cerebellum (CT=26.2), with expression also seen across all brain areas represented in this panel. This expression profile is consistent with the brain expression seen in the CNS_neurodegeneration_v1.0 panel. Please see Panel 1.3D for discussion of utility of this gene in the central nervous system.

Overall, this gene is expressed mostly in normal tissues, with much lower expression in most cancer cell lines. This suggests that loss of expression of this gene might be required for the proliferation of these cancer cell lines. A moderate level of expression is seen in a lung cancer and two breast cancer cell lines. Thus, the loss of expression might be used as a diagnostic marker for most cancers, except the cancer tissues from which the lung and breast cancer cell lines were derived. In addition, the protein product of this gene might be of use in the treatment of these cancers.

This gene is also moderately expressed in a wide variety of metabolic tissues including pancreas, adrenal, thyroid, pituitary, adult and fetal heart, adult and fetal skeletal muscle, adult and fetal liver, and adipose. Carbonic anhydrase III is reduced in adipose tissue in several animal models of genetic obesity. Thus, an activator of this gene product could potentially be a drug treatment for the prevention and/or treatment of obesity in humans.

In addition, this gene is expressed at higher levels in fetal lung (CT=26.5) than in adult lung (CT=31.3). Thus, expression of this gene could be used to differentiate between fetal and adult lung tissue. The expression of this gene at significant levels in the lung is consistent with published reports (see references below.) This suggests that the gene product is involved in the homeostasis of the lung. Therefore, therapeutic modulation of the expression or function of the protein encoded by this gene could be effective in treating disease that affect the lung or its function.

References:

Takahashi H, et al. Detection and identification of subcutaneous adipose tissue proteins related to obesity in New Zealand obese mouse. Endocr J 48:205–11, 2001.

New Zealand obese (NZO) mouse, a genetic model of obesity, shows hyperphagia, hyperinsulinemia and leptin resistance. We analyzed subcutaneous adipose tissue proteins in NZO mice with a two-dimensional gel electrophoresis technique followed by protein sequence analysis. NZO mice showed hyperinsulinemia and hyperleptinemia. Abdominal subcutaneous adipose tissue was inspected in NZO and C57BL/6J lean mice. Two-dimensional gel electrophoresis detected 4 spots which were obviously reduced in NZO mice. Those spots were p26, p19, p18 and p15. Internal sequences of the p26 and p15 protein were homologous with those of carbonic anhydrase III, p19 was cytochrome b5, p18 was superoxide dismutase. Serum arachidonic acid level in NZO mice was lower by 80% of C57BL/6J mice. The present study demonstrated the reduction of several enzymes related to lipid metabolism in NZO mice. These data raises the hypothesis that the supposed changes of membrane fluidity caused by altered membrane lipid content may involve central leptin resistance of this model of obesity.

PMID: 11456269

Stanton L W, et al. Expression of CAIII in rodent models of obesity. Mol Endocrinol 5:860–6, 1991.

To achieve a better understanding of the biochemical basis of obesity, we have undertaken comparative analyses of adipose tissue of lean and obese mice. By two-dimensional gel analysis, carbonic anhydrase-III (CA III)

has been identified as a major constituent of murine adipose tissue. Quantitative comparisons of CA III protein and mRNA levels indicate that this enzyme is expressed at lower levels in adipose tissue from animals that were either genetically obese or had experimentally induced obesity compared to levels in the corresponding lean controls. This decrease in CA III expression was unique to adipose tissue, since other CA III-containing organs and tissues did not show a change when lean and obese animals were compared. Additionally, levels of CA III in adipose tissue from obese animals responded to acute changes in energy balance of the animal. These results are discussed in light of possible metabolic roles for CA III.

PMID: 1922100

Mahieu I, Benjamin A, Stephens R, Walters D, Carter N. Characterization of membrane bound carbonic anhydrase IV (CA IV) located on the external surface of lung pulmonary endothelial cells. Biochem Soc Trans 1995 May;23(2):320S

PMID: 7672351

Panel 1.3D Summary: Ag1677 The expression of the CG56164-01 gene was assessed in two independent runs on this panel and there appears to be good concordance between runs. This gene is expressed mostly innormal tissues, with much lower expression in most cancer cell lines. Highest expression of the gene in this panel is seen in the lung (CTs=28). This significant expression in the lung is consistent with the results in General_screening_panel_ v1.4 and suggests that this gene product is involved in the homeostasis of this organ. The higher association of this gene with normal tissues suggests that loss of expression of this gene might be required for the proliferation of the cancer cell lines in this panel. Thus, this loss of expression might be used as a diagnostic marker for cancer.

As in the previous panel, this gene is widely expressed in a variety of metabolic tissues including pancreas, adrenal, thyroid, pituitary, adult and fetal heart, adult and fetal skeletal muscle, and adipose. Thus, this gene product may be a small molecule target for the treatment of metabolic disease, including Types 1 and 2 diabetes.

This gene encodes a homolog of carbonic anhydrase which is a known marker for oligodendroglia. Carbonic anhydrase expression in the brain is useful for distinguishing between neurons and oligodendroglia. Thus, this gene product may utility in monitoring the progression of diseases that involve the myelinating function of oligodendroglia, such as Multiple Sclerosis and Alzheimer's disease.

Panel 2D Summary: Ag1677 As in the previous panels, expression of the CG56164-01 gene is more highly associated with normal tissues. Highest expression of the gene in this panel is seen in a normal colon sample (CT=27.8). Furthermore, expression of this gene is higher in normal colon, stomach, ovary, thyroid, kidney and lung than in the corresponding adjacent tumor tissues. Thus, the loss of expression of this gene could be used to distinguish malignant colon, lung, stomach, ovary, thyroid and kidney tissue from normal tissue from these organs. In addition, the protein product of this gene might be of use in the treatment of these cancers.

Panel 4D Summary: Ag1677 The CG55936-01 transcript is expressed at low but significant levels in the thymus, lung and kidney (CTs=30–35), again showing preferential expression in normal tissues. Thus, this gene or the protein it encodes could be used to detect these tissues. Therapeutically, the protein encoded for by this transcript could be used for immune modulation by regulating T cell development in the thymus.

NOV7 (CG55117-01)

Expression of gene CG55117-01 was assessed using the primer-probe set Ag819, described in Table 33A. Results of the RTQ-PCR runs are shown in Tables 33B, 33C, 33D, 33E and 33F.

TABLE 33A

PROBE NAME Ag819

| Primers | Sequences | | Length | Start Position |
|---|---|---|---|---|
| Forward | 5'-ggtccaacagggctatcaat-3' | (SEQ ID NO:192) | 20 | 1136 |
| Probe | TET-5'-ccaaaccacgactgtcgtagcaggta-3'-TAMRA | (SEQ ID NO:193) | 26 | 1187 |
| Reverse | 5'-tggaattcaagacccttttga-3' | (SEQ ID NO:194) | 21 | 1213 |

TABLE 33B

Panel 1.2

| Tissue Name | Rel. Exp. (%) Ag819, Run 118349021 | Rel. Exp. (%) Ag819, Run 120989791 | Tissue Name | Rel. Exp. (%) Ag819, Run 118349021 | Rel. Exp. (%) Ag819, Run 120989791 |
|---|---|---|---|---|---|
| Endothelial cells | 0.0 | 0.0 | Renal ca. 786-0 | 0.0 | 0.0 |
| Heart (Fetal) | 0.4 | 0.8 | Renal ca. A498 | 0.0 | 0.1 |
| Pancreas | 43.8 | 48.3 | Renal ca. RXF 393 | 0.0 | 0.0 |
| Pancreatic ca. CAPAN 2 | 8.1 | 17.9 | Renal ca. ACHN | 0.0 | 0.0 |
| Adrenal Gland | 0.2 | 0.2 | Renal ca. UO-31 | 1.0 | 1.6 |
| Thyroid | 11.8 | 12.9 | Renal ca. TK-10 | 0.0 | 0.0 |
| Salivary gland | 63.3 | 63.7 | Liver | 8.0 | 3.3 |
| Pituitary gland | 0.9 | 0.5 | Liver (fetal) | 2.8 | 2.7 |

TABLE 33B-continued

Panel 1.2

| Tissue Name | Rel. Exp. (%) Ag819, Run 118349021 | Rel. Exp. (%) Ag819, Run 120989791 | Tissue Name | Rel. Exp. (%) Ag819, Run 118349021 | Rel. Exp. (%) Ag819, Run 120989791 |
|---|---|---|---|---|---|
| Brain (fetal) | 37.1 | 41.5 | Liver ca. (hepatoblast) HepG2 | 12.8 | 20.2 |
| Brain (whole) | 4.6 | 6.3 | Lung | 5.7 | 4.2 |
| Brain (amygdala) | 1.5 | 2.3 | Lung (fetal) | 9.5 | 7.4 |
| Brain (cerebellum) | 0.9 | 1.5 | Lung ca. (small cell) LX-1 | 39.0 | 33.4 |
| Brain (hippocampus) | 3.4 | 4.0 | Lung ca. (small cell) NCI-H69 | 7.4 | 10.5 |
| Brain (thalamus) | 1.9 | 2.6 | Lung ca. (s. cell var.) SHP-77 | 0.5 | 0.6 |
| Cerebral Cortex | 1.2 | 2.7 | Lung ca. (large cell)NCI-H460 | 0.0 | 0.0 |
| Spinal cord | 1.2 | 1.9 | Lung ca. (non-sm. cell) A549 | 0.0 | 0.1 |
| glio/astro U87-MG | 0.0 | 0.0 | Lung ca. (non-s.cell) NCI-H23 | 0.0 | 0.0 |
| glio/astro U-118-MG | 0.0 | 0.0 | Lung ca. (non-s.cell) HOP-62 | 0.1 | 0.2 |
| astrocytoma SW1783 | 0.0 | 0.0 | Lung ca. (non-s.cl) NCI-H522 | 0.0 | 0.1 |
| neuro*; met SK-N-AS | 0.3 | 0.1 | Lung ca. (squam.) SW 900 | 0.6 | 0.8 |
| astrocytoma SF-539 | 0.0 | 0.0 | Lung ca. (squam.) NCI-H596 | 14.6 | 22.1 |
| astrocytoma SNB-75 | 0.0 | 0.0 | Mammary gland | 33.0 | 46.3 |
| glioma SNB-19 | 0.0 | 0.1 | Breast ca.* (pl.ef) MCF-7 | 0.0 | 0.0 |
| glioma U251 | 0.0 | 0.1 | Breast ca.* (pl.ef) MDA-MB-231 | 0.0 | 0.0 |
| glioma SF-295 | 0.0 | 0.0 | Breast ca.* (pl. ef) T47D | 0.8 | 1.3 |
| Heart | 8.1 | 9.5 | Breast ca. BT-549 | 0.0 | 0.0 |
| Skeletal Muscle | 2.6 | 3.7 | Breast ca. MDA-N | 0.4 | 0.6 |
| Bone marrow | 0.6 | 1.2 | Ovary | 4.6 | 0.2 |
| Thymus | 0.0 | 0.1 | Ovarian ca. OVCAR-3 | 3.3 | 4.0 |
| Spleen | 0.5 | 0.0 | Ovarian ca. OVCAR-4 | 27.9 | 54.0 |
| Lymph node | 1.4 | 0.2 | Ovarian ca. OVCAR-5 | 37.4 | 51.1 |
| Colorectal Tissue | 0.3 | 1.8 | Ovarian ca. OVCAR-8 | 0.0 | 0.1 |
| Stomach | 10.7 | 23.3 | Ovarian ca. IGROV-1 | 3.2 | 5.5 |
| Small intestine | 10.4 | 18.9 | Ovarian ca. (ascites) SK-OV-3 | 0.0 | 0.0 |
| Colon ca. SW480 | 0.0 | 0.0 | Uterus | 1.4 | 1.2 |
| Colon ca.* SW620 (SW480 met) | 9.0 | 11.7 | Placenta | 23.2 | 22.5 |
| Colon ca. HT29 | 32.5 | 40.9 | Prostate | 2.6 | 2.7 |
| Colon ca. HCT-116 | 5.9 | 7.9 | Prostate ca.* (bone met) PC-3 | 0.0 | 0.0 |
| Colon ca. CaCo-2 | 100.0 | 100.0 | Testis | 19.8 | 21.9 |
| Colon ca. Tissue (ODO3866) | 4.7 | 5.4 | Melanoma Hs688(A).T | 1.7 | 0.0 |
| Colon ca. HCC-2998 | 2.5 | 3.0 | Melanoma* (met) Hs688(B).T | 0.7 | 0.0 |
| Gastric ca.* (liver met) NCI-N87 | 0.0 | 0.2 | Melanoma UACC-62 | 1.8 | 1.7 |

TABLE 33B-continued

Panel 1.2

| Tissue Name | Rel. Exp. (%) Ag819, Run 118349021 | Rel. Exp. (%) Ag819, Run 120989791 | Tissue Name | Rel. Exp. (%) Ag819, Run 118349021 | Rel. Exp. (%) Ag819, Run 120989791 |
|---|---|---|---|---|---|
| Bladder | 39.2 | 49.7 | Melanoma M14 | 0.1 | 0.2 |
| Trachea | 29.7 | 34.4 | Melanoma LOX IMVI | 0.0 | 0.0 |
| Kidney | 27.4 | 25.7 | Melanoma* (met) SK-MEL-5 | 0.5 | 1.0 |
| Kidney (fetal) | 17.7 | 19.1 | | | |

TABLE 33C

Panel 2D

| Tissue Name | Rel. Exp. (%) Ag819, Run 144794769 | Rel. Exp. (%) Ag819, Run 146791894 | Tissue Name | Rel. Exp. (%) Ag819, Run 144794769 | Rel. Exp. (%) Ag819, Run 146791894 |
|---|---|---|---|---|---|
| Normal Colon | 17.0 | 20.7 | Kidney Margin 8120608 | 3.9 | 2.0 |
| CC Well to Mod Diff (ODO3866) | 0.9 | 5.3 | Kidney Cancer 8120613 | 0.1 | 0.0 |
| CC Margin (ODO3866) | 9.5 | 6.0 | Kidney Margin 8120614 | 1.2 | 0.8 |
| CC Gr.2 rectosigmoid (ODO3868) | 5.8 | 3.9 | Kidney Cancer 9010320 | 7.7 | 8.0 |
| CC Margin (ODO3868) | 0.0 | 0.2 | Kidney Margin 9010321 | 7.8 | 6.0 |
| CC Mod Diff (ODO3920) | 0.7 | 0.9 | Normal Uterus | 0.0 | 0.0 |
| CC Margin (ODO3920) | 2.8 | 2.1 | Uterus Cancer 064011 | 24.1 | 18.8 |
| CC Gr.2 ascend colon (ODO3921) | 26.2 | 37.4 | Normal Thyroid | 4.7 | 2.4 |
| CC Margin (ODO3921) | 4.4 | 7.0 | Thyroid Cancer 064010 | 4.0 | 2.2 |
| CC from Partial Hepatectomy (ODO4309) Mets | 13.1 | 20.4 | Thyroid Cancer A302152 | 0.1 | 0.0 |
| Liver Margin (ODO4309) | 0.1 | 0.2 | Thyroid Margin A302153 | 2.9 | 2.7 |
| Colon mets to lung (OD04451-01) | 8.5 | 6.2 | Normal Breast | 16.6 | 7.4 |
| Lung Margin (OD04451-02) | 2.1 | 1.7 | Breast Cancer (OD04566) | 0.6 | 0.4 |
| Normal Prostate 6546-1 | 1.2 | 0.3 | Breast Cancer (OD04590-01) | 0.8 | 0.5 |
| Prostate Cancer (OD04410) | 0.5 | 0.7 | Breast Cancer Mets (OD04590-03) | 0.0 | 0.0 |
| Prostate Margin (OD04410) | 0.8 | 0.6 | Breast Cancer Metastasis (OD04655-05) | 0.1 | 0.0 |
| Prostate Cancer (OD04720-01) | 0.4 | 0.4 | Breast Cancer 064006 | 15.7 | 11.7 |
| Prostate Margin (OD04720-02) | 2.0 | 2.0 | Breast Cancer 1024 | 12.1 | 11.6 |
| Normal Lung 061010 | 4.6 | 4.7 | Breast Cancer 9100266 | 1.2 | 0.6 |
| Lung Met to Muscle (ODO4286) | 0.0 | 0.0 | Breast Margin 9100265 | 3.0 | 2.0 |

TABLE 33C-continued

Panel 2D

| Tissue Name | Rel. Exp. (%) Ag819, Run 144794769 | Rel. Exp. (%) Ag819, Run 146791894 | Tissue Name | Rel. Exp. (%) Ag819, Run 144794769 | Rel. Exp. (%) Ag819, Run 146791894 |
|---|---|---|---|---|---|
| Muscle Margin (OD04286) | 0.2 | 0.3 | Breast Cancer A209073 | 6.5 | 4.6 |
| Lung Malignant Cancer (OD03126) | 8.7 | 6.5 | Breast Margin A2090734 | 25.0 | 9.0 |
| Lung Margin (OD03126) | 1.4 | 1.6 | Normal Liver | 0.6 | 0.5 |
| Lung Cancer (OD04404) | 0.1 | 0.2 | Liver Cancer 064003 | 0.0 | 0.0 |
| Lung Margin (OD04404) | 3.1 | 1.2 | Liver Cancer 1025 | 0.2 | 0.3 |
| Lung Cancer (OD04565) | 0.2 | 0.1 | Liver Cancer 1026 | 0.2 | 0.1 |
| Lung Margin (OD04565) | 1.0 | 0.9 | Liver Cancer 6004-T | 0.2 | 0.1 |
| Lung Cancer (OD04237-01) | 100.0 | 74.7 | Liver Tissue 6004-N | 1.6 | 1.7 |
| Lung Margin (OD04237-02) | 1.7 | 1.5 | Liver Cancer 6005-T | 0.1 | 0.2 |
| Ocular Mel Met to Liver (OD04310) | 0.1 | 0.3 | Liver Tissue 6005-N | 0.0 | 0.2 |
| Liver Margin (OD04310) | 0.6 | 0.2 | Normal Bladder | 14.8 | 18.7 |
| Melanoma Mets to Lung (OD04321) | 14.8 | 12.2 | Bladder Cancer 1023 | 6.9 | 6.4 |
| Lung Margin (OD04321) | 1.7 | 1.5 | Bladder Cancer A302173 | 0.2 | 0.1 |
| Normal Kidney | 23.2 | 17.4 | Bladder Cancer (OD04718-01) | 0.1 | 0.1 |
| Kidney Ca, Nuclear grade 2 (OD04338) | 4.2 | 5.1 | Bladder Normal Adjacent (OD04718-03) | 0.2 | 0.4 |
| Kidney Margin (OD04338) | 8.0 | 11.3 | Normal Ovary | 0.1 | 0.0 |
| Kidney Ca Nuclear grade 1/2 (OD04339) | 65.5 | 69.3 | Ovarian Cancer 064008 | 68.8 | 100.0 |
| Kidney Margin (OD04339) | 6.7 | 6.0 | Ovarian Cancer (OD04768-07) | 0.5 | 1.0 |
| Kidney Ca, Clear cell type (OD04340) | 0.1 | 0.1 | Ovary Margin (OD04768-08) | 0.0 | 0.1 |
| Kidney Margin (OD04340) | 13.8 | 12.0 | Normal Stomach | 5.0 | 4.5 |
| Kidney Ca, Nuclear grade 3 (OD04348) | 0.0 | 0.0 | Gastric Cancer 9060358 | 2.5 | 2.6 |
| Kidney Margin (OD04348) | 9.2 | 6.3 | Stomach Margin 9060359 | 5.6 | 7.0 |
| Kidney Cancer (OD04622-01) | 0.7 | 0.4 | Gastric Cancer 9060395 | 1.7 | 1.3 |
| Kidney Margin (OD04622-03) | 1.1 | 1.2 | Stomach Margin 9060394 | 3.4 | 6.4 |
| Kidney Cancer (OD04450-01) | 32.5 | 24.5 | Gastric Cancer 9060397 | 26.1 | 39.8 |
| Kidney Margin (OD04450-03) | 22.1 | 16.0 | Stomach Margin 9060396 | 2.7 | 2.7 |
| Kidney Cancer 8120607 | 4.4 | 4.2 | Gastric Cancer 064005 | 15.5 | 22.1 |

TABLE 33D

Panel 3D

| Tissue Name | Rel. Exp.(%) Ag819, Run 172133330 | Tissue Name | Rel. Exp.(%) Ag819, Run 172133330 |
|---|---|---|---|
| Daoy- Medulloblastoma | 0.9 | Ca Ski- Cervical epidermoid carcinoma (metastasis) | 0.0 |
| TE671- Medulloblastoma | 1.1 | ES-2- Ovarian clear cell carcinoma | 0.0 |
| D283 Med- Medulloblastoma | 100.0 | Ramos- Stimulated with PMA/ionomycin 6h | 0.0 |
| PFSK-1- Primitive Neuroectodermal | 0.0 | Ramos- Stimulated with PMA/ionomycin 14h | 0.0 |
| XF-498- CNS | 0.1 | MEG-01- Chronic myelogenous leukemia (megokaryoblast) | 0.0 |
| SNB-78- Glioma | 0.0 | Raji- Burkitt's lymphoma | 0.0 |
| SF-268- Glioblastoma | 0.0 | Daudi- Burkitt's lymphoma | 0.0 |
| T98G- Glioblastoma | 0.0 | U266- B-cell plasmacytoma | 0.0 |
| SK-N-SH- Neuroblastoma (metastasis) | 0.0 | CA46- Burkitt's lymphoma | 0.0 |
| SF-295-Glioblastoma | 0.0 | RL- non-Hodgkin's B-cell lymphoma | 0.0 |
| Cerebellum | 0.8 | JM1- pre-B-cell lymphoma | 0.0 |
| Cerebellum | 0.2 | Jurkat- T cell leukemia | 0.0 |
| NCI-H292- Mucoepidermoid lung carcinoma | 0.0 | TF-1- Erythroleukemia | 0.0 |
| DMS-114- Small cell lung cancer | 0.1 | HUT 78- T-cell lymphoma | 0.0 |
| DMS-79- Small cell lung cancer | 9.9 | U937- Histiocytic lymphoma | 0.0 |
| NCI-H146- Small cell lung cancer | 1.2 | KU-812- Myelogenous leukemia | 0.0 |
| NCI-H526- Small cell lung cancer | 0.0 | 769-P- Clear cell renal carcinoma | 0.0 |
| NCI-N417- Small cell lung cancer | 0.0 | Caki-2- Clear cell renal carcinoma | 0.0 |
| NCI-H82- Small cell lung cancer | 28.5 | SW 839- Clear cell renal carcinoma | 0.0 |
| NCI-H157- Squamous cell lung cancer (metastasis) | 0.0 | G401- Wilms' tumor | 0.0 |
| NCI-H1155- Large cell lung cancer | 3.4 | Hs766T- Pancreatic carcinoma (LN metastasis) | 0.0 |
| NCI-H1299- Large cell lung cancer | 0.0 | CAPAN-1- Pancreatic adenocarcinoma (liver metastasis) | 9.0 |
| NCI-H727- Lung carcinoid | 0.4 | SU86.86- Pancreatic carcinoma (liver metastasis) | 17.6 |
| NCI-UMC-11- Lung carcinoid | 10.4 | BxPC-3- Pancreatic adenocarcinoma | 0.0 |
| LX-1- Small cell lung cancer | 27.9 | HPAC- Pancreatic adenocarcinoma | 1.7 |
| Colo-205- Colon cancer | 3.0 | MIA PaCa-2- Pancreatic carcinoma | 0.0 |
| KM12- Colon cancer | 3.3 | CFPAC-1- Pancreatic ductal adenocarcinoma | 58.2 |
| KM20L2- Colon cancer | 1.2 | PANC-1- Pancreatic epithelioid ductal carcinoma | 0.0 |
| NCI-H716- Colon cancer | 0.0 | T24- Bladder carcinoma (transitional cell) | 0.0 |
| SW-48- Colon adenocarcinoma | 7.3 | 5637- Bladder carcinoma | 0.0 |
| SW1116- Colon adenocarcinoma | 3.7 | HT-1197- Bladder carcinoma | 0.0 |
| LS 174T- Colon adenocarcinoma | 0.2 | UM-UC-3- Bladder carcinoma (transitional cell) | 0.0 |
| SW-948- Colon adenocarcinoma | 0.0 | A204- Rhabdomyosarcoma | 0.0 |
| SW-480- Colon adenocarcinoma | 3.1 | HT-1080- Fibrosarcoma | 0.0 |
| NCI-SNU-5- Gastric carcinoma | 0.0 | MG-63- Osteosarcoma | 0.0 |
| KATO III- Gastric carcinoma | 0.0 | SK-LMS-1- Leiomyosarcoma (vulva) | 0.0 |

TABLE 33D-continued

Panel 3D

| Tissue Name | Rel. Exp.(%) Ag819, Run 172133330 | Tissue Name | Rel. Exp.(%) Ag819, Run 172133330 |
|---|---|---|---|
| NCI-SNU-16- Gastric carcinoma | 0.0 | SJRH30- Rhabdomyosarcoma (met to bone marrow) | 2.5 |
| NCI-SNU-1- Gastric carcinoma | 26.6 | A431- Epidermoid carcinoma | 0.0 |
| RF-1- Gastric adenocarcinoma | 0.0 | WM266-4- Melanoma | 0.2 |
| RF-48- Gastric adenocarcinoma | 0.1 | DU 145- Prostate carcinoma (brain metastasis) | 0.0 |
| MKN-45- Gastric carcinoma | 0.0 | MDA-MB-468- Breast adenocarcinoma | 11.2 |
| NCI-N87- Gastric carcinoma | 0.0 | SCC-4- Squamous cell carcinoma of tongue | 0.0 |
| OVCAR-5- Ovarian carcinoma | 0.0 | SCC-9- Squamous cell carcinoma of tongue | 0.0 |
| RL95-2- Uterine carcinoma | 0.0 | SCC-15- Squamous cell carcinoma of tongue | 0.0 |
| HelaS3-Cervical adenocarcinoma | 0.0 | CAL 27- Squamous cell carcinoma of tongue | 0.0 |

TABLE 33E

Panel 4D

| Tissue Name | Rel. Exp.(%) Ag819, Run 140345750 | Rel. Exp.(%) Ag819, Run 145385615 | Tissue Name | Rel. Exp.(%) Ag819, Run 140345750 | Rel. Exp.(%) Ag819, Run 145385615 |
|---|---|---|---|---|---|
| Secondary Th1 act | 0.0 | 0.0 | HUVEC IL-1beta | 0.0 | 0.0 |
| Secondary Th2 act | 0.7 | 0.2 | HUVEC IFN gamma | 0.0 | 0.0 |
| Secondary Tr1 act | 0.2 | 0.3 | HUVEC TNF alpha + IFN gamma | 0.0 | 0.0 |
| Secondary Th1 rest | 0.0 | 0.0 | HUVEC TNF alpha + IL4 | 0.0 | 0.0 |
| Secondary Th2 rest | 0.0 | 0.0 | HUVEC IL-11 | 0.0 | 0.1 |
| Secondary Tr1 rest | 0.0 | 0.0 | Lung Microvascular EC none | 0.0 | 0.0 |
| Primary Th1 act | 0.0 | 0.0 | Lung Microvascular EC TNFalpha + IL-1beta | 0.0 | 0.0 |
| Primary Th2 act | 0.0 | 0.0 | Microvascular Dermal EC none | 0.1 | 0.0 |
| Primary Tr1 act | 0.0 | 0.0 | Microvascular Dermal EC TNFalpha + IL-1beta | 0.0 | 0.0 |
| Primary Th1 rest | 0.0 | 0.0 | Bronchial epithelium TNFalpha + IL1beta | 0.0 | 0.1 |
| Primary Th2 rest | 0.0 | 0.0 | Small airway epithelium none | 0.0 | 0.0 |
| Primary Tr1 rest | 0.0 | 0.0 | Small airway epithelium TNFalpha + IL-1beta | 0.0 | 0.0 |
| CD45RA CD4 lymphocyte act | 0.0 | 0.1 | Coronery artery SMC rest | 0.0 | 0.0 |
| CD45RO CD4 lymphocyte act | 0.0 | 0.1 | Coronery artery SMC TNFalpha + IL-1beta | 0.0 | 0.0 |
| CD8 lymphocyte act | 0.0 | 0.0 | Astrocytes rest | 17.4 | 12.5 |
| Secondary CD8 lymphocyte rest | 0.3 | 0.1 | Astrocytes TNFalpha + IL-1beta | 8.5 | 8.8 |

TABLE 33E-continued

Panel 4D

| Tissue Name | Rel. Exp.(%) Ag819, Run 140345750 | Rel. Exp.(%) Ag819, Run 145385615 | Tissue Name | Rel. Exp.(%) Ag819, Run 140345750 | Rel. Exp.(%) Ag819, Run 145385615 |
|---|---|---|---|---|---|
| Secondary CD8 lymphocyte act | 0.0 | 0.0 | KU-812 (Basophil) rest | 0.0 | 0.0 |
| CD4 lymphocyte none | 0.0 | 0.0 | KU-812 (Basophil) PMA/ionomycin | 0.0 | 0.0 |
| 2ry Th1/Th2/Tr1_anti-CD95 CH11 | 0.0 | 0.0 | CCD1106 (Keratinocytes) none | 0.0 | 0.0 |
| LAK cells rest | 0.0 | 0.1 | CCD1106 (Keratinocytes) TNFalpha + IL-1beta | 0.0 | 0.1 |
| LAK cells IL-2 | 0.2 | 0.0 | Liver cirrhosis | 12.9 | 10.2 |
| LAK cells IL-2 + IL-12 | 0.0 | 0.0 | Lupus kidney | 24.7 | 34.6 |
| LAK cells IL-2 + IFN gamma | 0.1 | 0.3 | NCI-H292 none | 0.2 | 0.1 |
| LAK cells IL-2 + IL-18 | 0.0 | 0.2 | NCI-H292 IL-4 | 0.1 | 0.3 |
| LAK cells PMA/ionomycin | 0.0 | 0.0 | NCI-H292 IL-9 | 0.2 | 0.2 |
| NK Cells IL-2 rest | 0.0 | 0.0 | NCI-H292 IL-13 | 0.2 | 0.2 |
| Two Way MLR 3 day | 0.2 | 0.3 | NCI-H292 IFN gamma | 0.0 | 0.0 |
| Two Way MLR 5 day | 0.4 | 0.2 | HPAEC none | 0.0 | 0.1 |
| Two Way MLR 7 day | 0.5 | 0.3 | HPAEC TNF alpha + IL-1 beta | 0.0 | 0.0 |
| PBMC rest | 0.0 | 0.0 | Lung fibroblast none | 0.2 | 0.0 |
| PBMC PWM | 0.8 | 1.2 | Lung fibroblast TNF alpha + IL-1 beta | 0.0 | 0.0 |
| PBMC PHA-L | 0.1 | 0.2 | Lung fibroblast IL-4 | 0.0 | 0.1 |
| Ramos (B cell) none | 0.0 | 0.1 | Lung fibroblast IL-9 | 0.0 | 0.0 |
| Ramos (B cell) ionomycin | 0.0 | 0.1 | Lung fibroblast IL-13 | 0.0 | 0.0 |
| B lymphocytes PWM | 0.0 | 0.0 | Lung fibroblast IFN gamma | 0.0 | 0.0 |
| B lymphocytes CD40L and IL-4 | 0.0 | 0.0 | Dermal fibroblast CCD1070 rest | 0.1 | 0.0 |
| EOL-1 dbcAMP | 0.0 | 0.0 | Dermal fibroblast CCD1070 TNF alpha | 0.0 | 0.0 |
| EOL-1 dbcAMP PMA/ionomycin | 0.0 | 0.0 | Dermal fibroblast CCD1070 IL-1 beta | 0.0 | 0.0 |
| Dendritic cells none | 0.0 | 0.0 | Dermal fibroblast IFN gamma | 0.0 | 0.0 |
| Dendritic cells LPS | 0.0 | 0.0 | Dermal fibroblast IL-4 | 0.0 | 0.0 |
| Dendritic cells anti-CD40 | 0.1 | 0.0 | IBD Colitis 2 | 0.2 | 0.2 |
| Monocytes rest | 0.0 | 0.0 | IBD Crohn's | 2.8 | 1.9 |
| Monocytes LPS | 0.0 | 0.1 | Colon | 30.8 | 29.5 |
| Macrophages rest | 0.3 | 0.1 | Lung | 1.5 | 1.5 |
| Macrophages LPS | 0.0 | 0.0 | Thymus | 100.0 | 100.0 |
| HUVEC none | 0.0 | 0.0 | Kidney | 0.4 | 1.0 |
| HUVEC starved | 0.0 | 0.0 | | | |

TABLE 33F

Panel 5 Islet

| Tissue Name | Rel. Exp.(%) Ag819, Run 229431867 | Tissue Name | Rel. Exp.(%) Ag819, Run 229431867 |
|---|---|---|---|
| 97457_Patient-02go_adipose | 0.0 | 94709_Donor 2 AM - A_adipose | 0.0 |
| 97476_Patient-07sk_skeletal muscle | 0.5 | 94710_Donor 2 AM - B_adipose | 0.0 |
| 97477 Patient-07ut_uterus | 0.0 | 94711_Donor 2 AM - C_adipose | 0.0 |
| 97478_Patient-07pl_placenta | 12.4 | 94712_Donor 2 AD - A_adipose | 0.0 |
| 99167_Bayer Patient 1 | 7.9 | 94713_Donor 2 AD - B_adipose | 0.3 |
| 97482_Patient-08ut_uterus | 0.4 | 94714_Donor 2 AD - C_adipose | 0.0 |
| 97483 Patient-08pl_placenta | 20.9 | 94742_Donor 3 U - A_Mesenchymal Stem Cells | 0.0 |
| 97486_Patient-09sk_skeletal muscle | 0.0 | 94743_Donor 3 U - B_Mesenchymal Stem Cells | 0.0 |
| 97487_Patient-09ut_uterus | 0.0 | 94730_Donor 3 AM - A_adipose | 0.0 |
| 97488_Patient-09pl_placenta | 11.0 | 94731_Donor 3 AM - B_adipose | 0.0 |
| 97492_Patient-10ut_uterus | 8.1 | 94732_Donor 3 AM - C_adipose | 0.0 |
| 97493_Patient-10pl_placenta | 47.0 | 94733_Donor 3 AD - A_adipose | 0.0 |
| 97495_Patient-11go_adipose | 0.0 | 94734_Donor 3 AD - B_adipose | 0.0 |
| 97496_Patient-11sk_skeletal muscle | 1.2 | 94735_Donor 3 AD - C_adipose | 0.0 |
| 97497_Patient-11ut_uterus | 1.5 | 77138_Liver_HepG2untreated | 100.0 |
| 97498_Patient-11pl_placenta | 5.4 | 73556_Heart_Cardiac stromal cells (primary) | 0.0 |
| 97500_Patient-12go_adipose | 0.0 | 81735_Small Intestine | 38.2 |
| 97501_Patient-12sk_skeletal muscle | 1.1 | 72409_Kidney_Proximal Convoluted Tubule | 4.9 |
| 97502_Patient-12ut_uterus | 0.0 | 82685_Small intestine_Duodenum | 1.0 |
| 97503_Patient-12pl_placenta | 11.7 | 90650_Adrenal_Adrenocortical adenoma | 0.0 |
| 94721_Donor 2 U - A_Mesenchymal Stem Cells | 0.0 | 72410_Kidney_HRCE | 39.5 |
| 94722_Donor 2 U - B_Mesenchymal Stem Cells | 0.0 | 72411_Kidney HRE | 97.9 |
| 94723_Donor 2 U - C_Mesenchymal Stem Cells | 0.0 | 73139_Uterus_Uterine smooth muscle cells | 0.0 |

Panel 1.2 Summary: Ag819 The expression of the CG55117-01 gene was assessed in two independent runs in panel 1.2 with excellent concordance between the runs. The expression of this gene appears to be highest in a colon cancer cell line (CaCo-2)(CTs=25). In addition, there appears to be substantial expression in colon cancer cell lines and ovarian cancer cell lines. Thus, the expression of this gene could be used to distinguish the CaCo-2 derived sample from other samples in the panel.

Among tissues with metabolic function, this gene has moderate levels of expression in adrenal, thyroid, pituitary, skeletal muscle, and adult and fetal liver. It is highly expressed in pancreas (CT value=26). Although this gene has no reported dysregulation in metabolic disease, it may be a monoclonal antibody target for the treatment of diseases of the metabolic-endocrine axis, including obesity and Types 1 and 2 diabetes. In addition, this gene appears to be differentially expressed in adult (CT value=28) vs fetal heart (CT value=32–33), and may be useful for the identification of the adult phenotype in this tissue.

This gene also shows moderate expression in all CNS regions examined. However, its expression in the fetal brain is considerably higher (greater than 10-fold) suggesting a role in neurodevelopment. Prominin is believed to play a role in the formation of lipid membrane protrusions, their lipid content and membrane to membrane interactions, all critical for synapse formation. The expression of this gene in the developing brain supports a role in synaptogenesis for this molecule. Compensatory synaptogenesis has been shown to occur in the adult brain, especially in response to brain injury or neuronal loss. Therefore, therapeutic modulation of this gene or its protein product may be of therapeutic benefit in clinical conditions where an increase in compensatory synaptogenesis is desirable including stroke, head trauma, spinal cord trauma, Alzheimer's, Parkinson's or Huntington's diseases, multiple sclerosis, or ALS.

References:

Corbeil D, Roper K, Fargeas C A, Joester A, Huttner W B. Prominin: a story of cholesterol, plasma membrane protrusions and human pathology. Traffic 2001 February;2(2):82–91

Prominin is the first identified member of a novel family of polytopic membrane proteins conserved throughout the animal kingdom. It has an unusual membrane topology, containing five transmembrane domains and two large glycosylated extracellular loops. In mammals, prominin is expressed in various embryonic and adult epithelial cells, as well as in nonepithelial cells, such as hematopoietic stem cells. At the subcellular level, prominin is selectively localized in microvilli and other plasma membrane protrusions, irrespective of cell type. At the molecular level, prominin specifically interacts with membrane cholesterol and is a marker of a novel type of cholesterol-based lipid 'raft'. A frameshift mutation in the human prominin gene, which results in a truncated protein that is no longer transported to the cell surface, is associated with retinal degeneration. Given that prominin is concentrated in the plasma membrane evaginations at the base of the outer segment of rod photoreceptor cells, which are essential precursor structures in the biogenesis of photoreceptor disks, it is proposed that prominin has a role in the generation of plasma membrane protrusions, their lipid composition and organization and their membrane-to-membrane interactions.

Panel 2D Summary: Ag819 The expression of the CG55117-01 gene was assessed in two independent runs in panel 2D with the runs showing excellent concordance. The expression of this gene is found to be highest in samples derived from an ovarian cancer and a lung cancer (CTs=26). In addition, there is substantial expression seen in other cancer samples including a kidney cancer, two colon cancers and two gastric cancers. Thus, the expression of this gene could be used to distinguish the ovarian or lung cancer from the other samples in the panel. Moreover, therapeutic modulation of this gene, through the use of small molecule drugs, antibodies or protein therapeutics might be of benefit in the treatment of ovarian, lung, kidney, colon or gastric cancers.

Panel 3D Summary: Ag819 The expression of the CG55117-01 gene is highest in a sample derived from a brain cancer (medulloblastoma) derived cell line (D283 cells)(CT=28.3). In addition, there is substantial expression seen in several lung cancer cell lines, a gastric cancer cell line and several pancreatic cancer cell lines. Thus, the expression of this gene could be used to distinguish D283 cells from other samples in the panel. Moreover, therapeutic modulation of this gene, through the use of small molecule drugs, antibodies or protein therapeutics might be of benefit in the treatment of lung, brain, pancreatic or gastric cancers.

Panel 4D Summary: Ag819 The CG55117-01 gene, which encodes a 5-transmembrane protein, human haematopoietic progenitor cell antigen AC 133 homolog is expressed at moderate levels in thymus, colon, and lupus kidney. Therefore, antibodies and small molecule drugs that antagonize the function of the CG55117-01 gene product may reduce or eliminate the symptoms in patients with lupus nephritis.

Panel 5 Islet Summary: Ag819 The CG55117-01 gene has low levels of expression in placenta and islets (CTs=32–34). Thus, expression of this gene could be used to differentiate samples derived from these tissues from other samples on this panel.

NOV6 (CG55690-01)

Expression of gene CG55690-01 was assessed using the primer-probe sets Ag2256 and Ag4933, described in Tables 34A and 34B. Results of the RTQ-PCR runs are shown in Tables 34C, 34D, 34E, 34F, 34G, 34H, and 34I.

TABLE 34A

PROBE NAME Ag2256

| Primers | Sequences | | Length | Start Position |
|---|---|---|---|---|
| Forward | 5'-cacgcactgccactataagg-3' | (SEQ ID NO:195) | 20 | 1717 |
| Probe | TET-5'-cttgcacatgactaagacggacccct-3'-TAMRA | (SEQ ID NO:196) | 26 | 1750 |
| Reverse | 5'-ctagaggtgtgtgggttctc-3' | (SEQ ID NO:197) | 21 | 1781 |

TABLE 34B

PROBE NAME Ag4933

| Primers | Sequences | | Length | Start Position |
|---|---|---|---|---|
| Forward | 5'-cacgcactgccactataagg-3' | (SEQ ID NO:198) | 20 | 1717 |
| Probe | TET-5'-cttgcacatgactaagacggacccct-3'-TAMRA | (SEQ ID NO:199) | 26 | 1750 |
| Reverse | 5'-ctagaggtgtgtgggttctc-3' | (SEQ ID NO:200) | 21 | 1781 |

TABLE 34C

CNS_neurodegeneration_v1.0

| Tissue Name | Rel. Exp.(%) Ag2256, Run 207967145 | Tissue Name | Rel. Exp.(%) Ag2256, Run 207967145 |
|---|---|---|---|
| AD 1 Hippo | 83.5 | Control (Path) 3 Temporal Ctx | 57.4 |
| AD 2 Hippo | 75.3 | Control (Path) 4 Temporal Ctx | 31.4 |

TABLE 34C-continued

CNS_neurodegeneration_v1.0

| Tissue Name | Rel. Exp.(%) Ag2256, Run 207967145 | Tissue Name | Rel. Exp.(%) Ag2256, Run 207967145 |
|---|---|---|---|
| AD 3 Hippo | 19.5 | AD 1 Occipital Ctx | 33.7 |
| AD 4 Hippo | 13.1 | AD 2 Occipital Ctx (Missing) | 1.4 |
| AD 5 hippo | 92.0 | AD 3 Occipital Ctx | 57.8 |
| AD 6 Hippo | 57.8 | AD 4 Occipital Ctx | 27.0 |
| Control 2 Hippo | 49.7 | AD 5 Occipital Ctx | 15.2 |
| Control 4 Hippo | 12.3 | AD 6 Occipital Ctx | 29.3 |
| Control (Path) 3 Hippo | 28.1 | Control 1 Occipital Ctx | 12.7 |
| AD 1 Temporal Ctx | 47.6 | Control 2 Occipital Ctx | 41.8 |
| AD 2 Temporal Ctx | 37.1 | Control 3 Occipital Ctx | 27.2 |
| AD 3 Temporal Ctx | 49.0 | Control 4 Occipital Ctx | 27.7 |
| AD 4 Temporal Ctx | 80.1 | Control (Path) 1 Occipital Ctx | 40.9 |
| AD 5 Inf Temporal Ctx | 58.2 | Control (Path) 2 Occipital Ctx | 11.0 |
| AD 5 Sup Temporal Ctx | 34.9 | Control (Path) 3 Occipital Ctx | 19.3 |
| AD 6 Inf Temporal Ctx | 28.9 | Control (Path) 4 Occipital Ctx | 22.5 |
| AD 6 Sup Temporal Ctx | 31.0 | Control 1 Parietal Ctx | 1.5 |
| Control 1 Temporal Ctx | 7.1 | Control 2 Parietal Ctx | 61.6 |
| Control 2 Temporal Ctx | 31.6 | Control 3 Parietal Ctx | 12.1 |
| Control 3 Temporal Ctx | 59.0 | Control (Path) 1 Parietal Ctx | 20.7 |
| Control 4 Temporal Ctx | 44.8 | Control (Path) 2 Parietal Ctx | 50.0 |
| Control (Path) 1 Temporal Ctx | 100.0 | Control (Path) 3 Parietal Ctx | 52.1 |
| Control (Path) 2 Temporal Ctx | 29.3 | Control (Path) 4 Parietal Ctx | 15.8 |

TABLE 34D

General_screening_panel_v1.5

| Tissue Name | Rel. Exp. (%) Ag2256, Run 229393821 | Rel. Exp. (%) Ag4933, Run 228843452 | Tissue Name | Rel. Exp. (%) Ag2256, Run 229393821 | Rel. Exp. (%) Ag4933, Run 228843452 |
|---|---|---|---|---|---|
| Adipose | 8.1 | 4.3 | Renal ca. TK-10 | 4.1 | 6.5 |
| Melanoma* Hs688(A).T | 4.1 | 4.3 | Bladder | 2.6 | 2.0 |
| Melanoma* Hs688(B).T | 1.0 | 2.8 | Gastric ca. (liver met.) NCI-N87 | 0.3 | 0.0 |
| Melanoma* M14 | 19.6 | 27.0 | Gastric ca. KATO III | 0.0 | 0.0 |
| Melanoma* LOXIMVI | 0.9 | 0.0 | Colon ca. SW-948 | 5.2 | 1.0 |
| Melanoma* SK-MEL-5 | 30.6 | 24.7 | Colon ca. SW480 | 48.0 | 79.0 |
| Squamous cell carcinoma SCC-4 | 0.4 | 0.0 | Colon ca.* (SW480 met) SW620 | 31.4 | 31.6 |
| Testis Pool | 6.2 | 9.6 | Colon ca. HT29 | 0.0 | 1.4 |
| Prostate ca.* (bone met) PC-3 | 3.6 | 3.3 | Colon ca. HCT-116 | 7.6 | 7.5 |
| Prostate Pool | 3.6 | 2.6 | Colon ca. CaCo-2 | 2.3 | 9.7 |
| Placenta | 5.3 | 2.2 | Colon cancer tissue | 0.8 | 2.2 |
| Uterus Pool | 0.2 | 0.0 | Colon ca. SW1116 | 0.0 | 0.0 |
| Ovarian ca. OVCAR-3 | 2.5 | 5.4 | Colon ca. Colo-205 | 0.0 | 0.0 |

TABLE 34D-continued

| | General_screening_panel_v1.5 | | | | |
|---|---|---|---|---|---|
| Tissue Name | Rel. Exp. (%) Ag2256, Run 229393821 | Rel. Exp. (%) Ag4933, Run 228843452 | Tissue Name | Rel. Exp. (%) Ag2256, Run 229393821 | Rel. Exp. (%) Ag4933, Run 228843452 |
| Ovarian ca. SK-OV-3 | 17.2 | 13.6 | Colon ca. SW-48 | 0.0 | 1.1 |
| Ovarian ca. OVCAR-4 | 11.3 | 12.9 | Colon Pool | 3.4 | 5.3 |
| Ovarian ca. OVCAR-5 | 15.0 | 10.2 | Small Intestine Pool | 2.7 | 1.0 |
| Ovarian ca. IGROV-1 | 3.2 | 12.1 | Stomach Pool | 0.0 | 1.0 |
| Ovarian ca. OVCAR-8 | 25.9 | 36.9 | Bone Marrow Pool | 0.8 | 1.9 |
| Ovary | 1.1 | 0.3 | Fetal Heart | 0.0 | 0.0 |
| Breast ca. MCF-7 | 4.0 | 1.9 | Heart Pool | 0.0 | 0.2 |
| Breast ca. MDA-MB-231 | 0.9 | 1.0 | Lymph Node Pool | 4.2 | 2.1 |
| Breast ca. BT 549 | 7.7 | 17.4 | Fetal Skeletal Muscle | 6.2 | 8.9 |
| Breast ca. T47D | 3.8 | 6.9 | Skeletal Muscle Pool | 23.2 | 30.1 |
| Breast ca. MDA-N | 0.0 | 0.0 | Spleen Pool | 0.8 | 1.1 |
| Breast Pool | 0.7 | 0.0 | Thymus Pool | 2.1 | 0.9 |
| Trachea | 14.9 | 15.8 | CNS cancer (glio/astro) U87-MG | 0.0 | 0.0 |
| Lung | 0.0 | 0.0 | CNS cancer (glio/astro) U-118-MG | 0.0 | 0.0 |
| Fetal Lung | 3.5 | 4.6 | CNS cancer (neuro;met) SK-N-AS | 0.7 | 0.0 |
| Lung ca. NCI-N417 | 17.9 | 41.8 | CNS cancer (astro) SF-539 | 2.6 | 7.0 |
| Lung ca. LX-1 | 4.6 | 6.0 | CNS cancer (astro) SNB-75 | 15.5 | 16.8 |
| Lung ca. NCI-H146 | 100.0 | 100.0 | CNS cancer (glio) SNB-19 | 13.5 | 16.5 |
| Lung ca. SHP-77 | 2.3 | 3.0 | CNS cancer (glio) SF-295 | 0.0 | 0.0 |
| Lung ca. A549 | 0.0 | 4.6 | Brain (Amygdala) Pool | 11.4 | 13.3 |
| Lung ca. NCI-H526 | 6.0 | 2.5 | Brain (cerebellum) | 21.0 | 19.5 |
| Lung ca. NCI-H23 | 26.8 | 35.4 | Brain (fetal) | 11.9 | 18.4 |
| Lung ca. NCI-H460 | 27.9 | 29.9 | Brain (Hippocampus) Pool | 7.3 | 7.1 |
| Lung ca. HOP-62 | 0.0 | 3.0 | Cerebral Cortex Pool | 6.2 | 7.6 |
| Lung ca. NCI-H522 | 16.7 | 17.4 | Brain (Substantia nigra) Pool | 13.7 | 11.0 |
| Liver | 0.1 | 2.4 | Brain (Thalamus) Pool | 9.8 | 11.7 |
| Fetal Liver | 6.2 | 4.6 | Brain (whole) | 8.5 | 17.7 |
| Liver ca. HepG2 | 4.7 | 8.2 | Spinal Cord Pool | 17.1 | 15.3 |
| Kidney Pool | 1.8 | 4.2 | Adrenal Gland | 0.7 | 2.6 |
| Fetal Kidney | 2.0 | 0.0 | Pituitary gland Pool | 3.1 | 8.0 |
| Renal ca. 786-0 | 0.0 | 0.0 | Salivary Gland | 1.6 | 8.0 |
| Renal ca. A498 | 4.6 | 6.7 | Thyroid (female) | 1.6 | 2.7 |
| Renal ca. ACHN | 1.1 | 3.5 | Pancreatic ca. CAPAN2 | 0.0 | 0.0 |
| Renal ca. UO-31 | 2.2 | 7.6 | Pancreas Pool | 2.1 | 4.2 |

TABLE 34E

Panel 1.3D

| Tissue Name | Rel. Exp. (%) Ag2256, Run 148422104 | Rel. Exp. (%) Ag2256, Run 148493664 | Tissue Name | Rel. Exp. (%) Ag2256, Run 148422104 | Rel. Exp. (%) Ag2256, Run 148493664 |
|---|---|---|---|---|---|
| Liver adenocarcinoma | 0.0 | 0.0 | Kidney (fetal) | 1.3 | 1.8 |
| Pancreas | 0.0 | 0.9 | Renal ca. 786-0 | 1.0 | 0.0 |
| Pancreatic ca. CAPAN 2 | 0.0 | 0.0 | Renal ca. A498 | 0.5 | 4.7 |
| Adrenal gland | 3.2 | 4.1 | Renal ca. RXF 393 | 0.0 | 0.0 |
| Thyroid | 0.0 | 0.0 | Renal ca. ACHN | 1.4 | 2.3 |
| Salivary gland | 7.9 | 5.5 | Renal ca. UO-31 | 0.0 | 6.1 |
| Pituitary gland | 12.2 | 1.7 | Renal ca. TK-10 | 0.0 | 0.0 |
| Brain (fetal) | 1.3 | 1.6 | Liver | 0.0 | 0.0 |
| Brain (whole) | 11.7 | 20.2 | Liver (fetal) | 1.2 | 12.9 |
| Brain (amygdala) | 18.8 | 31.0 | Liver ca. (hepatoblast) HepG2 | 2.1 | 0.0 |
| Brain (cerebellum) | 0.0 | 0.0 | Lung | 1.2 | 0.0 |
| Brain (hippocampus) | 85.9 | 95.3 | Lung (fetal) | 2.8 | 2.2 |
| Brain (substantia nigra) | 8.9 | 10.9 | Lung ca. (small cell) LX-1 | 0.0 | 4.4 |
| Brian (thalamus) | 70.7 | 39.5 | Lung ca. (small cell) NCI-H69 | 23.5 | 30.8 |
| Cerebral Cortex | 17.1 | 11.9 | Lung ca. (s.cell var.) SHP-77 | 0.2 | 3.8 |
| Spinal cord | 2.7 | 4.0 | Lung ca. (large cell) NCI-H460 | 8.5 | 2.9 |
| glio/astro U87-MG | 0.0 | 0.9 | Lung ca. (non-sm. cell) A549 | 1.6 | 2.2 |
| glio/astro U-118-MG | 0.0 | 0.0 | Lung ca. (non-s.cell) NCI-H23 | 8.8 | 13.6 |
| astrocytoma SW1783 | 12.4 | 12.4 | Lung ca. (non-s.cell) HOP-62 | 0.0 | 1.7 |
| neuro*; met SK-N-AS | 0.0 | 0.0 | Lung ca. (non-s.cl) NCI-H522 | 6.0 | 10.1 |
| astrocytoma SF-539 | 1.6 | 7.0 | Lung ca. (squam.) SW 900 | 1.0 | 4.7 |
| astrocytoma SNB-75 | 0.0 | 4.5 | Lung ca. (squam.) NCI-H596 | 31.9 | 27.9 |
| glioma SNB-19 | 0.0 | 0.0 | Mammary gland | 0.0 | 5.1 |
| glioma U251 | 0.0 | 0.0 | Breast ca.* (pl.ef) MCF-7 | 0.0 | 0.0 |
| glioma SF-295 | 0.0 | 0.0 | Breast ca.* (pl.ef) MDA-MB-231 | 0.0 | 0.0 |
| Heart (fetal) | 1.1 | 2.1 | Breast ca.* (pl.ef) T47D | 2.5 | 3.4 |
| Heart | 0.0 | 0.0 | Breast ca. BT-549 | 7.3 | 6.3 |
| Skeletal muscle (fetal) | 100.0 | 100.0 | Breast ca. MDA-N | 0.0 | 0.0 |
| Skeletal muscle | 1.1 | 11.7 | Ovary | 2.1 | 4.5 |
| Bone marrow | 2.9 | 0.0 | Ovarian ca. OVCAR-3 | 0.0 | 2.0 |
| Thymus | 0.0 | 2.3 | Ovarian ca. OVCAR-4 | 1.3 | 2.0 |
| Spleen | 0.6 | 0.0 | Ovarian ca. OVCAR-5 | 0.0 | 0.0 |
| Lymph node | 1.3 | 3.4 | Ovarian ca. OVCAR-8 | 3.2 | 0.0 |
| Colorectal | 5.4 | 0.0 | Ovarian ca. IGROV-1 | 0.0 | 0.0 |

TABLE 34E-continued

Panel 1.3D

| Tissue Name | Rel. Exp. (%) Ag2256, Run 148422104 | Rel. Exp. (%) Ag2256, Run 148493664 | Tissue Name | Rel. Exp. (%) Ag2256, Run 148422104 | Rel. Exp. (%) Ag2256, Run 148493664 |
|---|---|---|---|---|---|
| Stomach | 0.6 | 2.9 | Ovarian ca.* (ascites) SK-OV-3 | 1.5 | 2.0 |
| Small intestine | 15.6 | 11.7 | Uterus | 1.1 | 1.1 |
| Colon ca. SW480 | 15.9 | 33.2 | Placenta | 2.1 | 2.5 |
| Colon ca.* SW620 (SW480 met) | 1.3 | 0.0 | Prostate | 5.7 | 11.6 |
| Colon ca. HT29 | 0.0 | 0.0 | Prostate ca.* (bone met) PC-3 | 1.1 | 0.0 |
| Colon ca. HCT-116 | 0.0 | 0.0 | Testis | 40.9 | 85.3 |
| Colon ca. CaCo-2 | 1.2 | 1.3 | Melanoma Hs688(A).T | 2.3 | 0.0 |
| Colon ca. tissue (ODO3866) | 0.0 | 0.0 | Melanoma* (met) Hs688(B).T | 1.3 | 5.7 |
| Colon ca. HCC-2998 | 8.9 | 13.6 | Melanoma UACC-62 | 6.8 | 2.2 |
| Gastric ca.* (liver met) NCI-N87 | 0.0 | 2.3 | Melanoma M14 | 7.7 | 14.6 |
| Bladder | 0.0 | 2.6 | Melanoma LOX IMVI | 0.0 | 0.0 |
| Trachea | 18.4 | 15.5 | Melanoma* (met) SK-MEL-5 | 3.7 | 9.2 |
| Kidney | 0.0 | 1.0 | Adipose | 2.4 | 2.3 |

TABLE 34F

Panel 2D

| Tissue Name | Rel. Exp. (%) Ag2256, Run 148422111 | Rel. Exp. (%) Ag2256, Run 148493675 | Tissue Name | Rel. Exp. (%) Ag2256, Run 148422111 | Rel. Exp. (%) Ag2256, Run 148493675 |
|---|---|---|---|---|---|
| Normal Colon | 3.3 | 5.0 | Kidney Margin 8120608 | 6.7 | 0.0 |
| CC Well to Mod Diff (ODO3866) | 5.7 | 1.0 | Kidney Cancer 8120613 | 0.0 | 0.0 |
| CC Margin (ODO3866) | 15.4 | 5.8 | Kidney Margin 8120614 | 0.0 | 0.0 |
| CC Gr.2 rectosigmoid (ODO3868) | 0.0 | 0.0 | Kidney Cancer 9010320 | 6.2 | 0.0 |
| CC Margin (ODO3868) | 0.0 | 4.7 | Kidney Margin 9010321 | 3.1 | 2.5 |
| CC Mod Diff (ODO3920) | 1.6 | 11.1 | Normal Uterus | 6.3 | 0.0 |
| CC Margin (ODO3920) | 0.0 | 2.5 | Uterus Cancer 064011 | 0.0 | 0.0 |
| CC Gr.2 ascend colon (ODO3921) | 16.7 | 2.2 | Normal Thyroid | 8.3 | 4.9 |
| CC Margin (ODO3921) | 5.6 | 4.3 | Thyroid Cancer 064010 | 2.9 | 0.0 |
| CC from Partial Hepatectomy (ODO4309) Mets | 2.5 | 0.0 | Thyroid Cancer A302152 | 0.0 | 0.0 |
| Liver Margin (ODO4309) | 7.7 | 0.0 | Thyroid Margin A302153 | 6.1 | 10.3 |
| Colon mets to lung (OD04451-01) | 39.2 | 31.6 | Normal Breast | 12.9 | 5.9 |

TABLE 34F-continued

Panel 2D

| Tissue Name | Rel. Exp. (%) Ag2256, Run 148422111 | Rel. Exp. (%) Ag2256, Run 148493675 | Tissue Name | Rel. Exp. (%) Ag2256, Run 148422111 | Rel. Exp. (%) Ag2256, Run 148493675 |
|---|---|---|---|---|---|
| Lung Margin (OD04451-02) | 0.0 | 0.0 | Breast Cancer (OD04566) | 2.6 | 3.9 |
| Normal Prostate 6546-1 | 21.9 | 19.3 | Breast Cancer (OD04590-01) | 0.0 | 1.9 |
| Prostate Cancer (OD04410) | 10.6 | 14.9 | Breast Cancer Mets (OD04590-03) | 6.0 | 13.5 |
| Prostate Margin (OD04410) | 48.3 | 30.1 | Breast Cancer Metastasis (OD04655-05) | 8.4 | 0.0 |
| Prostate Cancer (OD04720-01) | 14.1 | 5.0 | Breast Cancer 064006 | 0.0 | 5.0 |
| Prostate Margin (OD04720-02) | 21.5 | 20.7 | Breast Cancer 1024 | 3.2 | 6.5 |
| Normal Lung 061010 | 6.8 | 9.0 | Breast Cancer 9100266 | 0.0 | 0.0 |
| Lung Met to Muscle (ODO4286) | 0.0 | 1.1 | Breast Margin 9100265 | 3.1 | 0.0 |
| Muscle Margin (ODO4286) | 24.0 | 9.3 | Breast Cancer A209073 | 3.4 | 3.2 |
| Lung Malignant Cancer (OD03126) | 5.4 | 0.0 | Breast Margin A2090734 | 6.7 | 6.0 |
| Lung Margin (OD03126) | 9.7 | 4.9 | Normal Liver | 0.0 | 0.0 |
| Lung Cancer (OD04404) | 13.7 | 11.7 | Liver Cancer 064003 | 5.1 | 0.0 |
| Lung Margin (OD04404) | 3.0 | 2.4 | Liver Cancer 1025 | 0.0 | 0.0 |
| Lung Cancer (OD04565) | 0.0 | 0.0 | Liver Cancer 1026 | 5.0 | 25.9 |
| Lung Margin (OD04565) | 0.0 | 0.0 | Liver Cancer 6004-T | 0.0 | 0.0 |
| Lung Cancer (OD04237-01) | 100.0 | 100.0 | Liver Tissue 6004-N | 5.0 | 11.8 |
| Lung Margin (OD04237-02) | 0.0 | 0.0 | Liver Cancer 6005-T | 16.2 | 18.4 |
| Ocular Mel Met to Liver (ODO4310) | 77.9 | 73.2 | Liver Tissue 6005-N | 0.0 | 0.0 |
| Liver Margin (ODO4310) | 0.0 | 3.0 | Normal Bladder | 4.5 | 2.7 |
| Melanoma Mets to Lung (OD04321) | 39.5 | 39.8 | Bladder Cancer 1023 | 0.0 | 1.1 |
| Lung Margin (OD04321) | 0.0 | 4.9 | Bladder Cancer A302173 | 7.3 | 11.0 |
| Normal Kidney | 6.0 | 4.1 | Bladder Cancer (OD04718-01) | 3.7 | 0.0 |
| Kidney Ca, Nuclear grade 2 (OD04338) | 2.9 | 12.9 | Bladder Normal Adjacent (OD04718-03) | 1.4 | 5.4 |
| Kidney Margin (OD04338) | 3.7 | 0.0 | Normal Ovary | 4.0 | 8.0 |
| Kidney Ca Nuclear grade 1/2 (OD04339) | 0.0 | 0.0 | Ovarian Cancer 064008 | 8.1 | 2.7 |
| Kidney Margin (OD04339) | 2.3 | 0.0 | Ovarian Cancer (OD04768-07) | 13.7 | 11.4 |
| Kidney Ca, Clear cell type (OD04340) | 2.5 | 4.0 | Ovary Margin (OD04768-08) | 1.6 | 2.0 |
| Kidney Margin (OD04340) | 9.3 | 4.2 | Normal Stomach | 7.6 | 1.5 |
| Kidney Ca, Nuclear grade 3 (OD04348) | 0.0 | 0.0 | Gastric Cancer 9060358 | 1.7 | 0.0 |

TABLE 34F-continued

Panel 2D

| Tissue Name | Rel. Exp. (%) Ag2256, Run 148422111 | Rel. Exp. (%) Ag2256, Run 148493675 | Tissue Name | Rel. Exp. (%) Ag2256, Run 148422111 | Rel. Exp. (%) Ag2256, Run 148493675 |
|---|---|---|---|---|---|
| Kidney Margin (OD04348) | 2.9 | 0.0 | Stomach Margin 9060359 | 5.6 | 0.0 |
| Kidney Cancer (OD04622-01) | 11.3 | 2.3 | Gastric Cancer 9060395 | 0.0 | 2.5 |
| Kidney Margin (OD04622-03) | 0.0 | 0.0 | Stomach Margin 9060394 | 3.5 | 2.7 |
| Kidney Cancer (OD04450-01) | 12.7 | 18.6 | Gastric Cancer 9060397 | 0.0 | 0.0 |
| Kidney Margin (OD04450-03) | 0.0 | 0.0 | Stomach Margin 9060396 | 0.0 | 0.0 |
| Kidney Cancer 8120607 | 3.1 | 4.8 | Gastric Cancer 064005 | 0.0 | 0.0 |

TABLE 34G

Panel 3D

| Tissue Name | Rel. Exp.(%) Ag2256, Run 170745682 | Tissue Name | Rel. Exp.(%) Ag2256, Run 170745682 |
|---|---|---|---|
| Daoy- Medulloblastoma | 0.5 | Ca Ski- Cervical epidermoid carcinoma (metastasis) | 12.8 |
| TE671- Medulloblastoma | 5.3 | ES-2- Ovarian clear cell carcinoma | 1.0 |
| D283 Med- Medulloblastoma | 7.0 | Ramos- Stimulated with PMA/ionomycin 6 h | 0.0 |
| PFSK-1- Primitive Neuroectodermal | 1.5 | Ramos- Stimulated with PMA/ionomycin 14 h | 0.0 |
| XF-498- CNS | 0.0 | MEG-01- Chronic myelogenous leukemia (megokaryoblast) | 0.0 |
| SNB-78- Glioma | 0.0 | Raji- Burkitt's lymphoma | 0.0 |
| SF-268- Glioblastoma | 2.0 | Daudi- Burkitt's lymphoma | 0.0 |
| T98G- Glioblastoma | 0.0 | U266- B-cell plasmacytoma | 0.2 |
| SK-N-SH- Neuroblastoma (metastasis) | 15.8 | CA46- Burkitt's lymphoma | 0.0 |
| SF-295- Glioblastoma | 0.0 | RL- non-Hodgkin's B-cell lymphoma | 0.0 |
| Cerebellum | 6.4 | JM1- pre-B-cell lymphoma | 0.0 |
| Cerebellum | 6.5 | Jurkat- T cell leukemia | 0.0 |
| NCI-H292- Mucoepidermoid lung carcinoma | 0.0 | TF-1- Erythroleukemia | 0.7 |
| DMS-114- Small cell lung cancer | 22.2 | HUT 78- T-cell lymphoma | 0.0 |
| DMS-79- Small cell lung cancer | 0.0 | U937- Histiocytic lymphoma | 3.6 |
| NCI-H146- Small cell lung cancer | 100.0 | KU-812- Myelogenous leukemia | 0.0 |
| NCI-H526- Small cell lung cancer | 9.5 | 769-P- Clear cell renal carcinoma | 0.0 |
| NCI-N417- Small cell lung cancer | 26.1 | Caki-2- Clear cell renal carcinoma | 0.9 |
| NCI-H82- Small cell lung cancer | 1.7 | SW 839- Clear cell renal carcinoma | 0.0 |
| NCI-H157- Squamous cell lung cancer (metastasis) | 0.0 | G401- Wilms' tumor | 0.0 |
| NCI-H1155- Large cell lung cancer | 24.5 | Hs766T- Pancreatic carcinoma (LN metastasis) | 0.0 |
| NCI-H1299- Large cell lung cancer | 14.9 | CAPAN-1- Pancreatic adenocarcinoma (liver metastasis) | 0.0 |
| NCI-H727- Lung carcinoid | 1.8 | SU86.86- Pancreatic carcinoma (liver metastasis) | 0.1 |

TABLE 34G-continued

Panel 3D

| Tissue Name | Rel. Exp.(%) Ag2256, Run 170745682 | Tissue Name | Rel. Exp.(%) Ag2256, Run 170745682 |
|---|---|---|---|
| NCI-UMC-11- Lung carcinoid | 1.7 | BxPC-3- Pancreatic adenocarcinoma | 1.5 |
| LX-1- Small cell lung cancer | 6.3 | HPAC- Pancreatic adenocarcinoma | 0.0 |
| Colo-205- Colon cancer | 0.0 | MIA PaCa-2- Pancreatic carcinoma | 1.4 |
| KM12- Colon cancer | 4.4 | CFPAC-1- Pancreatic ductal adenocarcinoma | 1.4 |
| KM20L2- Colon cancer | 0.0 | PANC-1- Pancreatic epithelioid ductal carcinoma | 4.6 |
| NCI-H716- Colon cancer | 7.2 | T24- Bladder carcinoma (transitional cell) | 0.0 |
| SW-48- Colon adenocarcinoma | 0.0 | 5637- Bladder carcinoma | 0.0 |
| SW1116- Colon adenocarcinoma | 0.0 | HT-1197- Bladder carcinoma | 0.0 |
| LS 174T- Colon adenocarcinoma | 0.0 | UM-UC-3- Bladder carcinoma (transitional cell) | 0.0 |
| SW-948- Colon adenocarcinoma | 0.0 | A204- Rhabdomyosarcoma | 3.5 |
| SW-480- Colon adenocarcinoma | 0.0 | HT-1080- Fibrosarcoma | 0.0 |
| NCI-SNU-5- Gastric carcinoma | 6.7 | MG-63- Osteosarcoma | 0.0 |
| KATO III- Gastric carcinoma | 23.2 | SK-LMS-1- Leiomyosarcoma (vulva) | 0.0 |
| NCI-SNU-16- Gastric carcinoma | 0.0 | SJRH30- Rhabdomyosarcoma (met to bone marrow) | 0.0 |
| NCI-SNU-1- Gastric carcinoma | 0.0 | A431- Epidermoid carcinoma | 0.0 |
| RF-1- Gastric adenocarcinoma | 0.9 | WM266-4- Melanoma | 4.9 |
| RF-48- Gastric adenocarcinoma | 0.0 | DU 145- Prostate carcinoma (brain metastasis) | 0.0 |
| MKN-45- Gastric carcinoma | 0.0 | MDA-MB-468- Breast adenocarcinoma | 4.1 |
| NCI-N87- Gastric carcinoma | 0.0 | SCC-4- Squamous cell carcinoma of tongue | 0.0 |
| OVCAR-5- Ovarian carcinoma | 0.3 | SCC-9- Squamous cell carcinoma of tongue | 0.0 |
| RL95-2- Uterine carcinoma | 2.0 | SCC-15- Squamous cell carcinoma of tongue | 0.0 |
| HelaS3- Cervical adenocarcinoma | 0.0 | CAL 27- Squamous cell carcinoma of tongue | 0.0 |

TABLE 34H

Panel 4.1D

| Tissue Name | Rel. Exp.(%) Ag4933, Run 223597253 | Tissue Name | Rel. Exp.(%) Ag4933, Run 223597253 |
|---|---|---|---|
| Secondary Th1 act | 1.5 | HUVEC IL-1 beta | 0.4 |
| Secondary Th2 act | 1.5 | HUVEC IFN gamma | 1.6 |
| Secondary Tr1 act | 2.5 | HUVEC TNF alpha + IFN gamma | 1.9 |
| Secondary Th1 rest | 0.0 | HUVEC TNF alpha + IL4 | 0.0 |
| Secondary Th2 rest | 0.0 | HUVEC IL-11 | 1.0 |
| Secondary Tr1 rest | 0.0 | Lung Microvascular EC none | 13.4 |
| Primary Th1 act | 7.1 | Lung Microvascular EC TNFalpha + IL-1 beta | 3.4 |
| Primary Th2 act | 7.1 | Microvascular Dermal EC none | 0.7 |
| Primary Tr1 act | 3.5 | Microvascular Dermal EC TNFalpha + IL-1 beta | 4.8 |
| Primary Th1 rest | 0.8 | Bronchial epithelium TNFalpha + IL1 beta | 0.0 |

TABLE 34H-continued

Panel 4.1D

| Tissue Name | Rel. Exp.(%) Ag4933, Run 223597253 | Tissue Name | Rel. Exp.(%) Ag4933, Run 223597253 |
|---|---|---|---|
| Primary Th2 rest | 0.0 | Small airway epithelium none | 0.0 |
| Primary Tr1 rest | 0.0 | Small airway epithelium TNFalpha + IL-1 beta | 0.0 |
| CD45RA CD4 lymphocyte act | 0.0 | Coronery artery SMC rest | 0.0 |
| CD45RO CD4 lymphocyte act | 0.0 | Coronery artery SMC TNFalpha + IL-1 beta | 0.0 |
| CD8 lymphocyte act | 0.0 | Astrocytes rest | 0.0 |
| Secondary CD8 lymphocyte rest | 1.4 | Astrocytes TNFalpha + IL-1 beta | 2.7 |
| Secondary CD8 lymphocyte act | 2.3 | KU-812 (Basophil) rest | 0.0 |
| CD4 lymphocyte none | 0.0 | KU-812 (Basophil) PMA/ionomycin | 0.9 |
| 2ry Th1/Th2/Tr1_anti-CD95 CH11 | 0.0 | CCD1106 (Keratinocytes) none | 0.0 |
| LAK cells rest | 1.3 | CCD1106 (Keratinocytes) TNFalpha + IL-1 beta | 4.6 |
| LAK cells IL-2 | 0.0 | Liver cirrhosis | 0.5 |
| LAK cells IL-2 + IL-12 | 0.0 | NCI-H292 none | 1.5 |
| LAK cells IL-2 + IFN gamma | 0.0 | NCI-H292 IL-4 | 0.0 |
| LAK cells IL-2 + IL-18 | 0.0 | NCI-H292 IL-9 | 0.0 |
| LAK cells PMA/ionomycin | 0.0 | NCI-H292 IL-13 | 0.0 |
| NK Cells IL-2 rest | 0.0 | NCI-H292 IFN gamma | 0.0 |
| Two Way MLR 3 day | 0.0 | HPAEC none | 0.0 |
| Two Way MLR 5 day | 0.0 | HPAEC TNF alpha + IL-1 beta | 0.0 |
| Two Way MLR 7 day | 1.9 | Lung fibroblast none | 0.7 |
| PBMC rest | 0.0 | Lung fibroblast TNF alpha + IL-1 beta | 1.5 |
| PBMC PWM | 1.5 | Lung fibroblast IL-4 | 3.3 |
| PBMC PHA-L | 0.0 | Lung fibroblast IL-9 | 4.4 |
| Ramos (B cell) none | 0.0 | Lung fibroblast IL-13 | 4.2 |
| Ramos (B cell) ionomycin | 0.0 | Lung fibroblast IFN gamma | 2.6 |
| B lymphocytes PWM | 1.6 | Dermal fibroblast CCD1070 rest | 1.7 |
| B lymphocytes CD40L and IL-4 | 0.9 | Dermal fibroblast CCD1070 TNF alpha | 0.0 |
| EOL-1 dbcAMP | 0.0 | Dermal fibroblast CCD1070 IL-1 beta | 3.6 |
| EOL-1 dbcAMP PMA/ionomycin | 0.0 | Dermal fibroblast IFN gamma | 0.0 |
| Dendritic cells none | 0.0 | Dermal fibroblast IL-4 | 3.8 |
| Dendritic cells LPS | 0.0 | Dermal Fibroblasts rest | 3.4 |
| Dendritic cells anti-CD40 | 0.0 | Neutrophils TNFa + LPS | 4.8 |
| Monocytes rest | 0.0 | Neutrophils rest | 3.4 |
| Monocytes LPS | 0.0 | Colon | 3.8 |
| Macrophages rest | 0.0 | Lung | 6.3 |
| Macrophages LPS | 1.6 | Thymus | 38.4 |
| HUVEC none | 0.0 | Kidney | 100.0 |
| HUVEC starved | 1.7 | | |

TABLE 34I

Panel 4D

| Tissue Name | Rel. Exp.(%) Ag2256, Run 148493657 | Tissue Name | Rel. Exp.(%) Ag2256, Run 148493657 |
|---|---|---|---|
| Secondary Th1 act | 1.6 | HUVEC IL-1 beta | 3.6 |
| Secondary Th2 act | 0.0 | HUVEC IFN gamma | 0.0 |
| Secondary Tr1 act | 7.7 | HUVEC TNF alpha + IFN gamma | 0.0 |
| Secondary Th1 rest | 0.0 | HUVEC TNF alpha + IL4 | 0.0 |

TABLE 34I-continued

Panel 4D

| Tissue Name | Rel. Exp.(%) Ag2256, Run 148493657 | Tissue Name | Rel. Exp.(%) Ag2256, Run 148493657 |
|---|---|---|---|
| Secondary Th2 rest | 0.0 | HUVEC IL-11 | 4.1 |
| Secondary Tr1 rest | 0.0 | Lung Microvascular EC none | 12.9 |
| Primary Th1 act | 11.1 | Lung Microvascular EC TNFalpha + IL-1 beta | 5.5 |
| Primary Th2 act | 17.0 | Microvascular Dermal EC none | 0.0 |
| Primary Tr1 act | 7.9 | Microvascular Dermal EC TNFalpha + IL-1 beta | 23.5 |
| Primary Th1 rest | 4.7 | Bronchial epithelium TNFalpha + IL1 beta | 0.0 |
| Primary Th2 rest | 0.0 | Small airway epithelium none | 0.0 |
| Primary Tr1 rest | 3.9 | Small airway epithelium TNFalpha + IL-1 beta | 3.8 |
| CD45RA CD4 lymphocyte act | 5.6 | Coronery artery SMC rest | 0.0 |
| CD45RO CD4 lymphocyte act | 3.8 | Coronery artery SMC TNFalpha + IL-1 beta | 3.4 |
| CD8 lymphocyte act | 0.0 | Astrocytes rest | 0.0 |
| Secondary CD8 lymphocyte rest | 0.0 | Astrocytes TNFalpha + IL-1 beta | 20.7 |
| Secondary CD8 lymphocyte act | 2.3 | KU-812 (Basophil) rest | 0.0 |
| CD4 lymphocyte none | 0.0 | KU-812 (Basophil) PMA/ionomycin | 0.0 |
| 2ry Th1/Th2/Tr1_anti-CD95 CH11 | 3.8 | CCD1106 (Keratinocytes) none | 8.2 |
| LAK cells rest | 0.0 | CCD1106 (Keratinocytes) TNFalpha + IL-1 beta | 16.5 |
| LAK cells IL-2 | 3.9 | Liver cirrhosis | 36.6 |
| LAK cells IL-2 + IL-12 | 0.0 | Lupus kidney | 0.0 |
| LAK cells IL-2 + IFN gamma | 0.0 | NCI-H292 none | 0.0 |
| LAK cells IL-2+ IL-18 | 1.6 | NCI-H292 IL-4 | 0.0 |
| LAK cells PMA/ionomycin | 9.4 | NCI-H292 IL-9 | 4.0 |
| NK Cells IL-2 rest | 0.0 | NCI-H292 IL-13 | 4.5 |
| Two Way MLR 3 day | 0.0 | NCI-H292 IFN gamma | 0.0 |
| Two Way MLR 5 day | 3.1 | HPAEC none | 4.8 |
| Two Way MLR 7 day | 7.8 | HPAEC TNF alpha + IL-1 beta | 3.4 |
| PBMC rest | 0.0 | Lung fibroblast none | 0.0 |
| PBMC PWM | 3.2 | Lung fibroblast TNF alpha + IL-1 beta | 0.0 |
| PBMC PHA-L | 0.0 | Lung fibroblast IL-4 | 2.6 |
| Ramos (B cell) none | 0.0 | Lung fibroblast IL-9 | 9.3 |
| Ramos (B cell) ionomycin | 0.0 | Lung fibroblast IL-13 | 11.8 |
| B lymphocytes PWM | 20.9 | Lung fibroblast IFN gamma | 7.1 |
| B lymphocytes CD40L and IL-4 | 0.0 | Dermal fibroblast CCD1070 rest | 0.0 |
| EOL-1 dbcAMP | 0.0 | Dermal fibroblast CCD1070 TNF alpha | 0.0 |
| EOL-1 dbcAMP PMA/ionomycin | 0.0 | Dermal fibroblast CCD1070 IL-1 beta | 27.4 |
| Dendritic cells none | 4.1 | Dermal fibroblast IFN gamma | 0.0 |
| Dendritic cells LPS | 0.0 | Dermal fibroblast IL-4 | 3.0 |
| Dendritic cells anti-CD40 | 0.0 | IBD Colitis 2 | 4.0 |
| Monocytes rest | 0.0 | IBD Crohn's | 3.6 |
| Monocytes LPS | 0.0 | Colon | 100.0 |
| Macrophages rest | 0.0 | Lung | 45.1 |
| Macrophages LPS | 2.4 | Thymus | 0.0 |
| HUVEC none | 0.0 | Kidney | 3.6 |
| HUVEC starved | 0.0 | | |

CNS_neurodegeneration_v1.0 Summary: Ag2256 Expression of the CG55690-01 gene is not differentially expressed in Alzheimer's disease, based on the expression in this panel. However, these results confirm expression of this gene in the brain. Please see General_screening_panel_v1.5 for discussion of utility of this gene in the central nervous system.

General_screening_panel_v1.5 Summary: Ag2256/Ag4933 Two experiments with the same probe and primer set show highest expression of the CG55690-01 gene in a sample derived from a lung cancer cell line (NCI-H146) (CTs=30). In addition, there are a number of lung cancer cell lines expressing this gene as well as colon cancer and ovarian cancer cell lines. Thus, the expression of this gene could be used to distinguish NCI-H1146 cells from other samples in the panel. Moreover, therapeutic modulation of this gene, through the use of small molecule drugs, protein therapeutics or antibodies might be of benefit in the treatment of lung cancer, colon cancer or ovarian cancer.

This gene also has moderate expression in adipose, adult and fetal skeletal muscle, and pituitary. Although this gene product has no reported associations with metabolic disease/metabolism, its expression profile suggests that it may be a monoclonal antibody target for the treatment of metabolic and endocrine disease, including obesity and Types 1 and 2 diabetes.

In addition, this gene is expressed at low levels in all CNS regions examined. This gene is a homolog of Frizzled. Frizzled genes play a role in cell fate determination. Therefore, this gene may be of use in stem cell research and therapy, specifically to control the differentiation of stem cells into post-mitotic neurons.

References:

Moriwaki J, Kajita E, Kirikoshi H, Koike J, Sagara N, Yasuhiko Y, Saitoh T, Hirai M, Katoh M, Shiokawa K. Isolation of Xenopus frizzled-10A and frizzled-10B genomic clones and their expression in adult tissues and embryos. Biochem Biophys Res Commun 2000 Nov. 19;278 (2):377–84

Frizzled genes, encoding WNT receptors, play key roles in cell fate determination. Here, we isolated two Xenopus frizzled genes (Xfz10A and Xfz10B), probably reflecting pseudotetraploidy in Xenopus. Xfz10A (586 amino acids) and Xfz10B (580 amino acids) both encoded by a single exon, consisted of the N-terminal cysteine-rich domain, seven transmembrane domains, and the C-terminal Ser/Thr-X-Val motif. Xfz10A and Xfz10B were 97.0% identical at the amino acid level, and Xfz10B was 100% identical to previously reported Xfz9, yet Xfz10A was 85.3% and 62.4% identical to FZD10 and FZD9, respectively. Xfz10 mRNA appeared as 3.4 kb in adult tissues and embryos. RT-PCR analyses revealed the expression of more Xfz10A mRNA in stomach, kidney, eye, skeletal muscle, and skin, and more Xfz10B mRNA in heart and ovary, but in embryos, two mRNAs were equally expressed from the blastula stage with their peak expression at the late gastrula stage. The main site of Xfz10 mRNA expression was neural fold at the neurula stage and the dorsal region of midbrain, hindbrain, and spinal cord at the tadpole stage. These results suggest that Xfz10 has important roles in neural tissue formation.

Panel 1.3D Summary: Ag2256 Two experiments with the same probe and primer set show highest expression of the CG55690-01 gene in fetal skeletal muscle (CTs=31–33). This gene is expressed at much higher levels in fetal skeletal muscle than in adult skeletal muscle (CTs=36–37). Therefore, expression of this gene could be used to differentiate between adult and fetal skeletal muscle. In addition, the higher levels of expression in fetal skeletal muscle suggest that the protein product may enhance muscular growth or development in the fetus and thus may also act in a regenerative capacity in the adult. Therefore, therapeutic modulation of the protein encoded by this gene could be useful in treatment of muscle related diseases. More specifically, treatment of weak or dystrophic muscle with the protein encoded by this gene could restore muscle mass or function.

This panel also shows expression of this gene in the CNS. Please see General Screening Panel 1.5 for a discussion of utility of this gene in the central nervous system.

Panel 2D Summary: Ag2256 The expression of the CG55690-01 gene was assessed in two independent runs in panel 2D with excellent concordance between runs. The expression of this gene is found to be highest in a sample derived from a lung cancer (CTs=30). In addition, other lung cancers were found to express this gene, while their normal adjacent tissue counterparts were low to undetectable for the expression of this gene. This expression is consistent with the expression seen in General_screening_panel_v1.5. Thus, the expression of this gene could be used to distinguish lung cancer samples from other samples in the panel and, in particular, normal adjacent lung tissue. Moreover, therapeutic modulation of this gene, through the use of small molecule drugs, antibodies or protein therapeutics might be beneficial in the treatment of lung cancer.

Panel 3D Summary: Ag2256 The expression of the CG55690-01 gene appears to be highest in a sample derived from a lung cancer cell line (NCI-H146)(CT=30). In addition, there is a cluster of lung cancer cell lines that appear to be expressing this gene, consistent with expression seen in previous panels. Thus, the expression of this gene could be used to distinguish NCI-H146 cells from other samples in the panel. Moreover, therapeutic modulation of this gene, through the use of small molecule drugs, antibodies or protein therapeutics might be beneficial in the treatment of lung cancer.

Panels 4.1D and 4D Summary: Ag4933 The CG55690-01 gene, a frizzled 9 homolog, is expressed at moderate levels in kidney (CT=31.31) and thymus (CT=32.69). Expression was analyzed independently with panel 4D and found to be at low levels in colon (CT=33.55) and lung (CT=34.7). Therefore, antibodies or small molecule antagonists that block the function of the CG55690-01 product may be useful to reduce or eliminate the symptoms in patients with diseases of kidney, thymus, colon, and lung.

Panel 5 Islet Summary: Ag2256 Expression of the CG55690-01 gene is low/undetectable in all samples on this panel (CTs>35). (Data not shown.)

NOV1 (CG56008-01)

Expression of gene CG56008-01 was assessed using the pnrmer-probe set Ag2169, described in Table 35A. Results of the RTQ-PCR runs are shown in Tables 35B, 35C, 35D and 35E.

TABLE 35A

PROBE NAME Ag2169

| Primers | Sequences | | Length | Start Position |
|---|---|---|---|---|
| Forward | 5'-cccgaaaaggctttatgtattc-3' | (SEQ ID NO:201) | 22 | 856 |
| Probe | TET-5'-cagaaacacaaatgaaaatcctcagga-3'-TAMRA | (SEQ ID NO:202) | 27 | 878 |
| Reverse | 5'-tgtcagtagctttgatgcattg-3' | (SEQ ID NO:203) | 22 | 911 |

TABLE 35B

Panel 1.3D

| Tissue Name | Rel. Exp. (%) Ag2169, Run 149923246 | Rel. Exp. (%) Ag2169, Run 151268473 | Tissue Name | Rel. Exp. (%) Ag2169, Run 149923246 | Rel. Exp. (%) Ag2169, Run 151268473 |
|---|---|---|---|---|---|
| Liver adenocarcinoma | 1.8 | 2.0 | Kidney (fetal) | 1.1 | 0.8 |
| Pancreas | 1.0 | 0.4 | Renal ca. 786-0 | 2.6 | 1.7 |
| Pancreatic ca. CAPAN 2 | 1.0 | 1.0 | Renal ca. A498 | 4.2 | 3.2 |
| Adrenal gland | 0.8 | 0.6 | Renal ca. RXF 393 | 1.2 | 0.8 |
| Thyroid | 2.0 | 0.9 | Renal ca. ACHN | 2.6 | 2.7 |
| Salivary gland | 1.2 | 0.8 | Renal ca. UO-31 | 3.3 | 2.4 |
| Pituitary gland | 3.1 | 2.2 | Renal ca. TK-10 | 2.0 | 1.5 |
| Brain (fetal) | 2.2 | 1.7 | Liver | 0.1 | 0.1 |
| Brain (whole) | 2.6 | 2.1 | Liver (fetal) | 0.5 | 0.3 |
| Brain (amygdala) | 2.0 | 1.1 | Liver ca. (hepatoblast) HepG2 | 1.5 | 1.3 |
| Brain (cerebellum) | 1.4 | 0.9 | Lung | 0.8 | 0.6 |
| Brain (hippocampus) | 6.1 | 4.5 | Lung (fetal) | 1.5 | 1.5 |
| Brain (substantia nigra) | 0.5 | 0.8 | Lung ca. (small cell) LX-1 | 1.0 | 0.7 |
| Brain (thalamus) | 2.5 | 2.0 | Lung ca. (small cell) NCI-H69 | 10.0 | 6.3 |
| Cerebral Cortex | 2.8 | 3.1 | Lung ca. (s.cell var.) SHP-77 | 3.9 | 4.9 |
| Spinal cord | 1.6 | 1.4 | Lung ca. (large cell)NCI-H460 | 1.3 | 1.2 |
| glio/astro U87-MG | 1.2 | 0.8 | Lung ca. (non-sm. cell) A549 | 0.9 | 0.6 |
| glio/astro U-118-MG | 12.0 | 9.3 | Lung ca. (non-s.cell) NCI-H23 | 5.4 | 0.0 |
| astrocytoma SW1783 | 2.8 | 3.0 | Lung ca. (non-s.cell) HOP-62 | 1.8 | 2.0 |
| neuro*; met SK-N-AS | 10.7 | 6.7 | Lung ca. (non-s.cl) NCI-H522 | 1.8 | 1.2 |
| astrocytoma SF-539 | 1.7 | 1.5 | Lung ca. (squam.) SW 900 | 1.2 | 0.8 |
| astrocytoma SNB-75 | 2.8 | 3.8 | Lung ca. (squam.) NCI-H596 | 3.1 | 3.0 |
| glioma SNB-19 | 1.0 | 0.9 | Mammary gland | 11.7 | 10.4 |
| glioma U251 | 0.8 | 0.8 | Breast ca.* (pl.ef) MCF-7 | 100.0 | 100.0 |
| glioma SF-295 | 3.4 | 3.0 | Breast ca.* (pl.ef) MDA-MB-231 | 2.5 | 2.1 |
| Heart (fetal) | 0.4 | 0.5 | Breast ca.* (pl.ef) T47D | 5.7 | 3.3 |

TABLE 35B-continued

Panel 1.3D

| Tissue Name | Rel. Exp. (%) Ag2169, Run 149923246 | Rel. Exp. (%) Ag2169, Run 151268473 | Tissue Name | Rel. Exp. (%) Ag2169, Run 149923246 | Rel. Exp. (%) Ag2169, Run 151268473 |
|---|---|---|---|---|---|
| Heart | 0.2 | 0.1 | Breast ca. BT-549 | 4.5 | 3.6 |
| Skeletal muscle (fetal) | 1.2 | 1.4 | Breast ca. MDA-N | 2.6 | 2.8 |
| Skeletal muscle | 0.2 | 0.2 | Ovary | 2.0 | 1.3 |
| Bone marrow | 0.4 | 0.2 | Ovarian ca. OVCAR-3 | 2.2 | 2.0 |
| Thymus | 0.3 | 0.3 | Ovarian ca. OVCAR-4 | 0.3 | 0.2 |
| Spleen | 1.1 | 0.8 | Ovarian ca. OVCAR-5 | 0.6 | 0.5 |
| Lymph node | 0.8 | 0.5 | Ovarian ca. OVCAR-8 | 1.6 | 0.9 |
| Colorectal | 0.3 | 0.2 | Ovarian ca. IGROV-1 | 0.8 | 0.5 |
| Stomach | 1.5 | 0.8 | Ovarian ca.* (ascites) SK-OV-3 | 4.0 | 3.2 |
| Small intestine | 0.9 | 0.5 | Uterus | 1.1 | 0.8 |
| Colon ca. SW480 | 1.6 | 1.2 | Placenta | 3.4 | 2.1 |
| Colon ca.* SW620(SW480 met) | 0.7 | 0.5 | Prostate | 5.5 | 4.6 |
| Colon ca. HT29 | 0.8 | 0.6 | Prostate ca.* (bone met)PC-3 | 2.0 | 1.3 |
| Colon ca. HCT-116 | 4.2 | 3.1 | Testis | 1.9 | 1.6 |
| Colon ca. CaCo-2 | 0.9 | 1.1 | Melanoma Hs688(A).T | 4.8 | 4.8 |
| Colon ca. tissue(ODO3866) | 1.3 | 1.2 | Melanoma* (met) Hs688(B).T | 6.2 | 5.2 |
| Colon ca. HCC-2998 | 2.1 | 1.6 | Melanoma UACC-62 | 0.3 | 0.3 |
| Gastric ca.* (liver met) NCI-N87 | 2.0 | 1.6 | Melanoma M14 | 2.8 | 2.6 |
| Bladder | 1.0 | 0.6 | Melanoma LOX IMVI | 0.6 | 0.4 |
| Trachea | 1.6 | 1.6 | Melanoma* (met) SK-MEL-5 | 7.1 | 5.1 |
| Kidney | 0.5 | 0.5 | Adipose | 1.2 | 0.8 |

TABLE 35C

Panel 2D

| Tissue Name | Rel. Exp. (%) Ag2169, Run 148722818 | Rel. Exp. (%) Ag2169, Run 149923296 | Tissue Name | Rel. Exp. (%) Ag2169, Run 148722818 | Rel. Exp. (%) Ag2169, Run 149923296 |
|---|---|---|---|---|---|
| Normal Colon | 3.2 | 3.1 | Kidney Margin 8120608 | 0.3 | 0.2 |
| CC Well to Mod Diff (ODO3866) | 0.6 | 0.5 | Kidney Cancer 8120613 | 0.4 | 0.4 |
| CC Margin (ODO3866) | 0.2 | 0.4 | Kidney Margin 8120614 | 0.2 | 0.2 |
| CC Gr.2 rectosigmoid (ODO3868) | 0.1 | 0.2 | Kidney Cancer 9010320 | 0.8 | 0.9 |
| CC Margin (ODO3868) | 0.2 | 0.1 | Kidney Margin 9010321 | 0.5 | 0.6 |
| CC Mod Diff (ODO3920) | 0.2 | 0.2 | Normal Uterus | 0.0 | 0.4 |
| CC Margin (ODO3920) | 0.3 | 0.2 | Uterus Cancer 064011 | 1.8 | 1.9 |

TABLE 35C-continued

Panel 2D

| Tissue Name | Rel. Exp. (%) Ag2169, Run 148722818 | Rel. Exp. (%) Ag2169, Run 149923296 | Tissue Name | Rel. Exp. (%) Ag2169, Run 148722818 | Rel. Exp. (%) Ag2169, Run 149923296 |
|---|---|---|---|---|---|
| CC Gr.2 ascend colon (OD03921) | 1.0 | 1.1 | Normal Thyroid | 1.4 | 1.8 |
| CC Margin (OD03921) | 0.3 | 0.4 | Thyroid Cancer 064010 | 1.7 | 1.9 |
| CC from Partial Hepatectomy (OD04309) Mets | 1.6 | 1.8 | Thyroid Cancer A302152 | 0.9 | 0.9 |
| Liver Margin (OD04309) | 0.5 | 0.4 | Thyroid Margin A302153 | 1.5 | 1.5 |
| Colon mets to lung (OD04451-01) | 0.2 | 0.2 | Normal Breast | 3.9 | 4.9 |
| Lung Margin (OD04451-02) | 0.4 | 0.3 | Breast Cancer (OD04566) | 19.8 | 26.2 |
| Normal Prostate 6546-1 | 7.7 | 7.9 | Breast Cancer (OD04590-01) | 46.7 | 45.7 |
| Prostate Cancer (OD04410) | 15.1 | 18.7 | Breast Cancer Mets (OD04590-03) | 43.2 | 57.8 |
| Prostate Margin (OD04410) | 7.4 | 7.9 | Breast Cancer Metastasis (OD04655-05) | 100.0 | 100.0 |
| Prostate Cancer (OD04720-01) | 3.4 | 4.0 | Breast Cancer 064006 | 2.4 | 2.7 |
| Prostate Margin (OD04720-02) | 6.7 | 7.3 | Breast Cancer 1024 | 2.5 | 2.3 |
| Normal Lung 061010 | 1.4 | 1.6 | Breast Cancer 9100266 | 41.2 | 45.7 |
| Lung Met to Muscle (OD04286) | 1.4 | 1.5 | Breast Margin 9100265 | 5.0 | 5.7 |
| Muscle Margin (OD04286) | 0.7 | 0.7 | Breast Cancer A209073 | 4.0 | 5.4 |
| Lung Malignant Cancer (OD03126) | 1.7 | 2.0 | Breast Margin A2090734 | 4.1 | 6.8 |
| Lung Margin (OD03126) | 1.1 | 1.3 | Normal Liver | 0.2 | 0.3 |
| Lung Cancer (OD04404) | 2.0 | 2.6 | Liver Cancer 064003 | 0.2 | 0.2 |
| Lung Margin (OD04404) | 1.0 | 1.2 | Liver Cancer 1025 | 0.2 | 0.1 |
| Lung Cancer (OD04565) | 1.0 | 1.1 | Liver Cancer 1026 | 0.3 | 0.2 |
| Lung Margin (OD04565) | 0.5 | 0.5 | Liver Cancer 6004-T | 0.2 | 0.2 |
| Lung Cancer (OD04237-01) | 3.1 | 3.4 | Liver Tissue 6004-N | 0.5 | 0.5 |
| Lung Margin (OD04237-02) | 0.9 | 1.0 | Liver Cancer 6005-T | 0.2 | 0.2 |
| Ocular Mel Met to Liver (OD04310) | 3.7 | 4.1 | Liver Tissue 6005-N | 0.1 | 0.1 |
| Liver Margin (OD04310) | 0.2 | 0.4 | Normal Bladder | 1.5 | 1.4 |
| Melanoma Mets to Lung (OD04321) | 3.5 | 4.0 | Bladder Cancer 1023 | 0.3 | 0.3 |
| Lung Margin (OD04321) | 0.9 | 1.4 | Bladder Cancer A302173 | 1.7 | 1.8 |
| Normal Kidney | 2.5 | 3.1 | Bladder Cancer (OD04718-01) | 3.0 | 3.3 |
| Kidney Ca, Nuclear grade 2 (OD04338) | 2.8 | 2.8 | Bladder Normal Adjacent (OD04718-03) | 2.9 | 1.4 |

TABLE 35C-continued

Panel 2D

| Tissue Name | Rel. Exp. (%) Ag2169, Run 148722818 | Rel. Exp. (%) Ag2169, Run 149923296 | Tissue Name | Rel. Exp. (%) Ag2169, Run 148722818 | Rel. Exp. (%) Ag2169, Run 149923296 |
|---|---|---|---|---|---|
| Kidney Margin (OD04338) | 1.8 | 1.9 | Normal Ovary | 0.3 | 0.3 |
| Kidney Ca Nuclear grade 1/2 (OD04339) | 0.7 | 0.6 | Ovarian Cancer 064008 | 3.3 | 3.0 |
| Kidney Margin (OD04339) | 1.4 | 1.4 | Ovarian Cancer (OD04768-07) | 3.1 | 3.1 |
| Kidney Ca, Clear cell type (OD04340) | 2.5 | 3.1 | Ovary Margin (OD04768-08) | 0.4 | 0.5 |
| Kidney Margin (OD04340) | 1.8 | 1.9 | Normal Stomach | 0.5 | 0.5 |
| Kidney Ca, Nuclear grade 3 (OD04348) | 1.0 | 0.9 | Gastric Cancer 9060358 | 0.2 | 0.2 |
| Kidney Margin (OD04348) | 1.5 | 1.7 | Stomach Margin 9060394 | 0.4 | 0.4 |
| Kidney Cancer (OD04622-01) | 0.9 | 0.9 | Gastric Cancer 9060395 | 0.8 | 0.7 |
| Kidney Margin (OD04622-03) | 0.2 | 0.1 | Stomach Margin 9060359 | 0.5 | 0.5 |
| Kidney Cancer (OD04450-01) | 1.1 | 1.0 | Gastric Cancer 9060397 | 1.0 | 0.9 |
| Kidney Margin (OD04450-03) | 1.4 | 1.5 | Stomach Margin 9060396 | 0.1 | 0.1 |
| Kidney Cancer 8120607 | 0.5 | 0.4 | Gastric Cancer 064005 | 1.0 | 0.8 |

TABLE 35D

Panel 3D

| Tissue Name | Rel. Exp.(%) Ag2169, Run 170745433 | Tissue Name | Rel. Exp.(%) Ag2169, Run 170745433 |
|---|---|---|---|
| Daoy-Medulloblastoma | 3.2 | Ca Ski- Cervical epidermoid carcinoma (metastasis) | 11.6 |
| TE671- Medulloblastoma | 1.2 | ES-2- Ovarian clear cell carcinoma | 4.4 |
| D283 Med- Medulloblastoma | 19.2 | Ramos- Stimulated with PMA/ionomycin 6 h | 5.0 |
| PFSK-1- Primitive Neuroectodermal | 16.4 | Ramos- Stimulated with PMA/ionomycin 14 h | 6.2 |
| XF-498- CNS | 15.5 | MEG-01- Chronic myelogenous leukemia (megokaryoblast) | 3.3 |
| SNB-78- Glioma | 20.3 | Raji- Burkitt's lymphoma | 1.2 |
| SF-268- Glioblastoma | 2.5 | Daudi- Burkitt's lymphoma | 4.6 |
| T98G-Glioblastoma | 5.4 | U266- B-cell plasmacytoma | 11.4 |
| SK-N-SH- Neuroblastoma (metastasis) | 16.5 | CA46- Burkitt's lymphoma | 2.1 |
| SF-295- Glioblastoma | 7.2 | RL- non-Hodgkin's B-cell lymphoma | 0.6 |
| Cerebellum | 6.1 | JM1- pre-B-cell lymphoma | 3.0 |
| Cerebellum | 2.5 | Jurkat- T cell leukemia | 11.7 |
| NCI-H292- Mucoepidermoid lung carcinoma | 32.8 | TF-1- Erythroleukemia | 2.9 |
| DMS-114- Small cell lung cancer | 9.1 | HUT 78- T-cell lymphoma | 2.9 |
| DMS-79- small cell lung cancer | 100.0 | U937- Histiocytic lymphoma | 4.2 |
| NCI-H146- small cell lung cancer | 31.6 | KU-812- Myelogenous leukemia | 1.3 |

TABLE 35D-continued

Panel 3D

| Tissue Name | Rel. Exp.(%) Ag2169, Run 170745433 | Tissue Name | Rel. Exp.(%) Ag2169, Run 170745433 |
|---|---|---|---|
| NCI-H526- Small cell lung cancer | 25.0 | 769-P- Clear cell renal carcinoma | 11.3 |
| NCI-N417- Small cell lung cancer | 5.0 | Caki-2- Clear cell renal carcinoma | 8.0 |
| NCI-H82- Small cell lung cancer | 10.1 | SW 839- Clear cell renal carcinoma | 2.6 |
| NCI-H157- Squamous cell lung cancer (metastasis) | 12.9 | G401- Wilms' tumor | 4.1 |
| NCI-H1155- Large cell lung cancer | 17.7 | Hs766T- Pancreatic carcinoma (LN metastasis) | 12.3 |
| NCI-H1299- Large cell lung cancer | 15.0 | CAPAN-1- Pancreatic adenocarcinoma (liver metastasis) | 2.2 |
| NCI-H727- Lung carcinoid | 4.0 | SU86.86- Pancreatic carcinoma (liver metastasis) | 3.2 |
| NCI-UMC-11- Lung carcinoid | 21.3 | BxPC-3- Pancreatic adenocarcinoma | 4.8 |
| LX-1- Small cell lung cancer | 6.1 | HPAC- Pancreatic adenocarcinoma | 10.4 |
| Colo-205- Colon cancer | 3.9 | MIA PaCa-2- Pancreatic carcinoma | 3.4 |
| KM12- Colon cancer | 6.1 | CFPAC-1- Pancreatic ductal adenocarcinoma | 22.1 |
| KM20L2- Colon cancer | 3.5 | PANC-1- Pancreatic epithelioid ductal carcinoma | 14.1 |
| NCI-H716- Colon cancer | 8.8 | T24- Bladder carcinoma (transitional cell) | 10.7 |
| SW-48- Colon adenocarcinoma | 4.2 | 5637- Bladder carcinoma | 11.8 |
| SW1116- Colon adenocarcinoma | 6.3 | HT-1197- Bladder carcinoma | 4.2 |
| LS 174T- Colon adenocarcinoma | 3.4 | UM-UC-3- Bladder carcinoma (transitional cell) | 2.5 |
| SW-948- Colon adenocarcinoma | 0.8 | A204- Rhabdomyosarcoma | 4.3 |
| SW-480- Colon adenocarcinoma | 3.2 | HT-1080- Fibrosarcoma | 15.3 |
| NCI-SNU-5- Gastric carcinoma | 1.4 | MG-63- Osteosarcoma | 3.5 |
| KATO III- Gastric carcinoma | 11.0 | SK-LMS-1- Leiomyosarcoma (vulva) | 10.2 |
| NCI-SNU-16- Gastric carcinoma | 7.2 | SJRH30- Rhabdomyosarcoma (met to bone marrow) | 3.1 |
| NCI-SNU-1- Gastric carcinoma | 9.2 | A431- Epidermoid carcinoma | 4.8 |
| RF-1- Gastric adenocarcinoma | 6.1 | WM266-4- Melanoma | 11.0 |
| RF-48- Gastric adenocarcinoma | 9.5 | DU 145- Prostate carcinoma (brain metastasis) | 0.0 |
| MKN-45- Gastric carcinoma | 12.8 | MDA-MB-468- Breast adenocarcinoma | 5.5 |
| NCI-N87- Gastric carcinoma | 4.4 | SCC-4- Squamous cell carcinoma of tongue | 0.0 |
| OVCAR-5- Ovarian carcinoma | 0.5 | SCC-9- Squamous cell carcinoma of tongue | 0.0 |
| RL95-2- Uterine carcinoma | 5.4 | SCC-15- Squamous cell carcinoma of tongue | 0.0 |
| HelaS3- Cervical adenocarcinoma | 11.7 | CAL 27- Squamous cell carcinoma of tongue | 7.3 |

TABLE 35E

Panel 4D

| Tissue Name | Rel. Exp. (%) Ag2169, Run 148725333 | Rel. Exp. (%) Ag2169, Run 163923835 | Tissue Name | Rel. Exp. (%) Ag2169, Run 148725333 | Rel. Exp. (%) Ag2169, Run 163923835 |
|---|---|---|---|---|---|
| Secondary Th1 act | 12.9 | 10.3 | HUVEC IL-1beta | 4.1 | 4.1 |
| Secondary Th2 act | 15.3 | 13.9 | HUVEC IFN gamma | 3.5 | 2.4 |
| Secondary Tr1 act | 17.6 | 16.3 | HUVEC TNF alpha + IFN gamma | 9.3 | 5.1 |
| Secondary Th1 rest | 2.2 | 1.5 | HUVEC TNF alpha + IL4 | 4.8 | 5.4 |
| Secondary Th2 rest | 2.9 | 2.7 | HUVEC IL-11 | 1.2 | 0.9 |
| Secondary Tr1 rest | 3.7 | 3.7 | Lung Microvascular EC none | 4.2 | 3.2 |
| Primary Th1 act | 18.7 | 22.7 | Lung Microvascular EC TNFalpha + IL-1beta | 7.3 | 5.4 |
| Primary Th2 act | 23.8 | 10.7 | Microvascular Dermal EC none | 4.3 | 4.8 |
| Primary Tr1 act | 24.3 | 17.6 | Microvascular Dermal EC TNFalpha + IL-1beta | 7.0 | 6.5 |
| Primary Th1 rest | 17.4 | 19.6 | Bronchial epithelium TNFalpha + IL1beta | 24.1 | 40.6 |
| Primary Th2 rest | 6.0 | 7.6 | Small airway epithelium none | 15.7 | 11.8 |
| Primary Tr1 rest | 6.2 | 6.0 | Small airway epithelium TNFalpha + IL-1beta | 100.0 | 100.0 |
| CD45RA CD4 lymphocyte act | 12.9 | 8.4 | Coronery artery SMC rest | 18.9 | 12.6 |
| CD45RO CD4 lymphocyte act | 21.2 | 12.8 | Coronery artery SMC TNFalpha + IL-1beta | 13.9 | 9.3 |
| CD8 lymphocyte act | 8.9 | 7.8 | Astrocytes rest | 16.7 | 13.6 |
| Secondary CD8 lymphocyte rest | 9.5 | 9.1 | Astrocytes TNFalpha + IL-1beta | 15.2 | 9.2 |
| Secondary CD8 lymphocyte act | 5.4 | 6.8 | KU-812 (Basophil) rest | 1.1 | 0.9 |
| CD4 lymphocyte none | 1.6 | 1.4 | KU-812 (Basophil) PMA/ionomycin | 5.5 | 3.9 |
| 2ry Th1/Th2/Tr1_anti-CD95 CH11 | 3.8 | 6.2 | CCD1106 (Keratinocytes) none | 14.8 | 10.3 |
| LAK cells rest | 8.4 | 6.8 | CCD1106 (Keratinocytes) TNFalpha + IL-1beta | 2.9 | 5.0 |
| LAK cells IL-2 | 8.2 | 10.3 | Liver cirrhosis | 0.9 | 0.9 |
| LAK cells IL-2 + IL-12 | 13.3 | 9.5 | Lupus kidney | 1.5 | 1.3 |
| LAK cells IL-2 + IFN gamma | 17.1 | 13.4 | NCI-H292 none | 30.8 | 21.6 |
| LAK cells IL-2 + IL-18 | 14.7 | 12.1 | NCI-H292 IL-4 | 40.6 | 31.4 |
| LAK cells PMA/ionomycin | 9.2 | 7.4 | NCI-H292 IL-9 | 35.8 | 28.9 |
| NK Cells IL-2 rest | 7.0 | 5.0 | NCI-H292 IL-13 | 17.7 | 13.3 |
| Two Way MLR 3 day | 7.3 | 7.0 | NCI-H292 IFN gamma | 23.8 | 17.3 |
| Two Way MLR 5 day | 7.3 | 6.8 | HPAEC none | 2.0 | 1.4 |
| Two Way MLR 7 day | 6.2 | 5.9 | HPAEC TNF alpha + IL-1 beta | 9.6 | 5.3 |

TABLE 35E-continued

Panel 4D

| Tissue Name | Rel. Exp. (%) Ag2169, Run 148725333 | Rel. Exp. (%) Ag2169, Run 163923835 | Tissue Name | Rel. Exp. (%) Ag2169, Run 148725333 | Rel. Exp. (%) Ag2169, Run 163923835 |
|---|---|---|---|---|---|
| PBMC rest | 1.9 | 2.1 | Lung fibroblast none | 15.2 | 11.4 |
| PBMC PWM | 41.2 | 47.3 | Lung fibroblast TNF alpha + IL-1 beta | 15.3 | 10.4 |
| PBMC PHA-L | 14.8 | 11.1 | Lung fibroblast IL-4 | 37.4 | 31.9 |
| Ramos (B cell) none | 9.7 | 8.8 | Lung fibroblast IL-9 | 23.2 | 17.8 |
| Ramos (B cell) ionomycin | 47.6 | 40.6 | Lung fibroblast IL-13 | 23.5 | 19.5 |
| B lymphocytes PWM | 71.2 | 70.2 | Lung fibroblast IFN gamma | 38.7 | 32.3 |
| B lymphocytes CD40L and IL-4 | 9.1 | 9.9 | Dermal Fibroblast CCD1070 rest | 36.3 | 33.7 |
| EOL-1 dbcAMP | 9.8 | 6.8 | Dermal fibroblast CCD1070 TNF alpha | 46.3 | 48.3 |
| EOL-1 dbcAMP PMA/ionomycin | 7.2 | 5.3 | Dermal fibroblast CCD1070 IL-1 beta | 18.6 | 18.8 |
| Dendritic cells none | 9.6 | 7.7 | Dermal fibroblast IFN gamma | 14.5 | 14.4 |
| Dendritic cells LPS | 18.3 | 10.5 | Dermal fibroblast IL-4 | 29.9 | 29.3 |
| Dendritic cells anti-CD40 | 12.2 | 9.2 | IBD Colitis 2 | 0.2 | 0.4 |
| Monocytes rest | 5.7 | 4.0 | IBD Crohn's | 0.5 | 0.4 |
| Monocytes LPS | 8.0 | 4.6 | Colon | 4.9 | 4.1 |
| Macrophages rest | 12.3 | 11.8 | Lung | 8.1 | 8.6 |
| Macrophages LPS | 4.8 | 4.1 | Thymus | 14.8 | 16.4 |
| HUVEC none | 3.9 | 2.7 | Kidney | 7.1 | 5.3 |
| HUVEC starved | 8.8 | 6.3 | | | |

Panel 1.3D Summary: Ag2169 The expression of the CG56008-01 gene was assessed in two independent runs in panel 1.3D with excellent concordance. The expression of this gene is highest in a sample derived from a breast cancer cell line (MCF-7)(CTs=25–26). Thus, the expression of this gene could be used to distinguish MCF-7 cells from the other samples in the panel. Moreover, therapeutic modulation of this gene, through the use of small molecule drugs, antibodies or protein therapeutics may be beneficial in the treatment of breast cancer.

This tissue is moderately expressed in a variety of metabolic tissues, including pancreas, adrenal, thyroid, pituitary, adult and fetal heart, fetal liver and adipose.

Thus, this gene product may be a monoclonal antibody target for the treatment of metabolic and endocrine disease, including obesity and Types 1 and 2 diabetes. As a putative zinc transporter, this gene may also be a potential target for the enhancement of insulin secretion and sensitivity in all forms of Type 2 diabetes. In addition, this gene is differentially expressed in fetal (CTs=31–32) vs adult skeletal muscle (CTs=34–35), and may be useful for the identification of the fetal source of this tissue. Furthermore, the relative overexpression of this gene in fetal skeletal muscle suggests that the protein product may enhance muscular growth or development in the fetus and thus may also act in a regenerative capacity in the adult. Therefore, therapeutic modulation of the protein encoded by this gene could be useful in treatment of muscle related diseases. More specifically, treatment of weak or dystrophic muscle with the protein encoded by this gene could restore muscle mass or function.

Among tissues of CNS origin, this gene is expressed at moderate levels in all regions examined. This gene, a LIV-1 homolog, may be involved in zinc homeostasis. Zinc is critical to brain functions as it may serve as an endogenous neuromodulator in synaptic neurotransmission. Thus, this gene would be a drug target for the treatment of learning deficiencies and seizure disorders associated with improper zinc trafficking.

References:

Tang X, Shay N F. Zinc has an insulin-like effect on glucose transport mediated by phosphoinositol-3-kinase and Akt in 3T3-L1 fibroblasts and adipocytes. J Nutr. 2001 May;131(5):1414–20.

Zinc has insulin-like effects on cells, including promotion of both lipogenesis and glucose transport. The relationship between zinc and the stimulation of glucose transport is unclear.

We hypothesize that zinc affects the insulin-signaling pathway. In this study, the effect of zinc on glucose transport and insulin signaling was examined in 3T3-L1-preadipocytes and -adipocytes. Treatment of cells with up to 200 micromol/L zinc significantly increased glucose transport (P<0.05). The effect of zinc on adipocytes was greater than on preadipocytes, and the effect of zinc plus insulin was greater than that of either insulin or zinc alone. Cytochalasin D, which disrupts actin filaments, attenuated the increase of glucose transport induced by zinc or insulin (P<0.05). At 100 mmol/L, wortmannin, the phosphoinositide (PI) 3-kinase inhibitor, decreased basal glucose transport and blocked zinc-stimulated glucose transport in both cell types (P<0.05). H7, an inhibitor of protein kinase C, did not reduce basal glucose transport but decreased zinc-induced glucose transport (P<0.05). Zinc increased tyrosine phosphorylation of the insulin receptor beta subunit of both preadipocytes and adipocytes after 5–10 min of treatment (P<0.05). Zinc at 200 micromol/L did not affect tyrosine phosphorylation of insulin receptor substrate (IRS)-1 or -2; further, there was no effect of zinc on the association of the p85 subunit of PI 3-kinase and IRS-1. Zinc significantly increased serine-473 phosphorylation of Akt in both preadipocytes and adipocytes (P] 0.05). The PI 3-kinase inhibitor, wortmannin, totally blocked the effect of zinc on Akt activation. Hence, it appears that zinc can induce an increase in glucose transport into cells and potentiate insulin-induced glucose transport, likely acting through the insulin-signaling pathway.

PMID: 11340092

Taylor K M. LIV-1 breast cancer protein belongs to new family of histidine-rich membrane proteins with potential to control intracellular Zn2+ homeostasis. IUBMB Life 2000 Apr.;49(4):249–53

Investigation of the protein product of the oestrogen-regulated gene LIV-1, implicated in metastatic breast cancer, has revealed 10 protein sequences of unknown function that belong to a new family with potential to control intracellular Zn2+ homeostasis. Sequence alignment highlights the similarity in transmembrane domains and extramembrane charged residues, indicating potential ion-transport ability. This family has a novel highly conserved motif of 66 residues, including a transmembrane domain and a catalytic zinc-binding sequence of zinc metalloproteases, containing conserved (indicated in bold type) proline and glutamine residues, HEXPHEXGD. These proteins contain more plentiful histidine-rich repeats than zinc transporters, suggesting an ability to bind or transport zinc across membranes. I propose that these 11 proteins form a new family with the potential to control intracellular Zn2+ homeostasis.

Takeda A. Movement of zinc and its functional significance in the brain. Brain Res Brain Res Rev 2000 Dec.;34 (3): 137–48

Zinc, an essential nutrient, is supplied to the brain via both the blood-brain and blood-cerebrospinal fluid barriers. Zinc is most concentrated in the limbic system, i.e. the hippocampus and amygdala, zinc-containing glutaminergic neuron-rich areas. A large portion of zinc serves the function of zinc metalloproteins in neurons and glial cells. In zinc-containing glutaminergic neurons, vesicular zinc, probably ionic zinc, may serve as an endogenous neuromodulator in synaptic neurotransmission. Vesicular zinc is dynamically coupled to the electrophysiological activity of zinc-containing glutaminergic neurons. Dietary zinc deprivation may influence zinc homeostasis in the brain, resulting in brain dysfunction such as learning impairment. Excessive excitation of zinc-containing glutaminergic neurons causes a decrease in vesicular zinc, and the decrease might be associated with the susceptibility to seizure. Alteration of zinc levels released into the synaptic cleft may influence neurotransmission in zinc-containing glutaminergic synapses. Therefore, zinc homeostasis in the presynaptic vesicle is important for the function of zinc-containing glutaminergic neurons Panel 2D Summary: Ag2169 The expression of the CG56008-01 gene was assessed in two independent runs in panel 2D with excellent concordance. It appears that the expression of this gene is highest in a sample derived from a breast cancer (CTs=23–24), consistent with expression in Panel 1.3D. In addition, there is a strong cluster of breast cancers expressing this gene, while expression of this gene in other tissues is almost absent, with the exception of a cluster of prostate derived samples. Thus, the expression of this gene could be used to distinguish breast cancer samples from the other samples in the panel. Moreover, therapeutic modulation of this gene, through the use of small molecule drugs, antibodies or protein therapeutics may be beneficial in the treatment of breast cancer.

Panel 3D Summary: Ag2169

The expression of the CG56008-01 gene appears to be highest is a sample derived from a lung cancer cell line (DMS 79)(CT=27.8). In addition, there appears to be significant levels of expression in a cluster of other lung cancer cell lines. Thus, the expression of this gene could be used to distinguish DMS 79 cells from other samples in the panel. Moreover, therapeutic modulation of this gene, through the use of small molecule drugs, antibodies or protein therapeutics may be beneficial in the treatment of lung cancer.

Panel 4D Summary: Ag2169 Two experiments with the same probe and primer set show highest expression of the CG56008-01 gene, a LIV-1 homolog in small airway epithelium stimulated with TNF-alpha and IL-1beta (CTs=27). Moderate levels of expression are also seen in pokeweed mitogen-activated peripheral blood mononuclear cells (mainly B cells), ionomycin-activated Ramos B cell, pokeweed mitogen-activated purified peripheral blood B lymphocytes, B lymphocytes activated with CD40L and IL-4, and a number of cytokine-activated and resting cells including NCI-H292 pulmonary mucoepidermoid epithelial cells, lung fibroblasts, and dermal fibroblasts. Based on these levels of expression in cytokine-activated B cells and cells in lung and skin, small molecule antagonists that block the function of this gene product may be useful as therapeutics that reduce or eliminate the symptoms in patients with autoimmune and inflammatory diseases in which activated B cells present antigens in the generation of the aberrant immune response, including Crohn's disease, ulcerative colitis, multiple sclerosis, chronic obstructive pulmonary disease, asthma, emphysema, rheumatoid arthritis, or psoriasis.

NOV1 (CG56008-03)

Expression of gene CG56008-03 was assessed using the primer-probe set Ag4704, described in Table 36A.

TABLE 36A

PROBE NAME Ag4704

| Primers | Sequences | | Length | Start Position |
|---|---|---|---|---|
| Forward | 5'-gcttttgggttttggaattatg-3' | (SEQ ID NO:204) | 22 | 962 |
| Probe | TET-5'-tccatatttgaacataaaatcgtgtttcg-3'-TAMRA | (SEQ ID NO:205) | 29 | 993 |
| Reverse | 5'-gtggtgatgatggagaattgaa-3' | (SEQ ID NO:206) | 22 | 1029 |

CNS_neurodegeneration_v1.0 Summary: Ag4704 Expression of the CG56008-03 gene is low/undetectable in all samples on this panel (CTs>35). (Data not shown.) The amp plot indicates that there is a high probability of a probe failure.

General_screening_panel_v1.4 Summary: Ag4704 Expression of the CG56008-03 gene is low/undetectable in all samples on this panel (CTs>35). (Data not shown.) The amp plot indicates that there is a high probability of a probe failure.

Panel 4.1D Summary: Ag4704 Expression of the CG56008-03 gene is low/undetectable in all samples on this panel (CTs>35). (Data not shown.) The amp plot indicates that there is a high probability of a probe failure.

NOV8 (CG56006-01)

Expression of gene CG56006-01 was assessed using the primer-probe set Ag1437, described in Table 37A. Results of the RTQ-PCR runs are shown in Tables 37B, 37C, 37D and 37E.

TABLE 37A

PROBE NAME Ag1437

| Primers | Sequences | | Length | Start Position |
|---|---|---|---|---|
| Forward | 5'-aggacagaacacctaggtgctt-3' | (SEQ ID NO:207) | 22 | 329 |
| Probe | TET-5'-ctcttcaggtccccaggaacccct-3'-TAMRA | (SEQ ID NO:208) | 24 | 284 |
| Reverse | 5'-cctaatgcccacctcctaatag-3' | (SEQ ID NO:209) | 22 | 262 |

TABLE 37B

Panel 1.2

| Tissue Name | Rel. Exp.(%) Ag1437, Run 138297722 | Tissue Name | Rel. Exp.(%) Ag1437, Run 138297722 |
|---|---|---|---|
| Endothelial cells | 0.0 | Renal ca. 786-0 | 0.0 |
| Heart (Fetal) | 4.5 | Renal ca. A498 | 0.1 |
| Pancreas | 1.8 | Renal ca. RXF 393 | 0.1 |
| Pancreatic ca. CAPAN 2 | 0.0 | Renal ca. ACHN | 0.0 |
| Adrenal Gland | 0.4 | Renal ca. UO-31 | 0.0 |
| Thyroid | 0.1 | Renal ca. TK-10 | 0.1 |
| Salivary gland | 1.2 | Liver | 46.7 |
| Pituitary gland | 0.0 | Liver (fetal) | 12.5 |
| Brain (fetal) | 0.0 | Liver ca. (hepatoblast) HepG2 | 18.8 |
| Brain (whole) | 0.1 | Lung | 0.2 |
| Brain (amygdala) | 0.1 | Lung (fetal) | 0.2 |
| Brain (cerebellum) | 0.1 | Lung ca. (small cell) LX-1 | 0.2 |
| Brain (hippocampus) | 0.4 | Lung ca. (small cell) NCI-H69 | 0.1 |
| Brain (thalamus) | 0.4 | Lung ca. (s.cell var.) SHP-77 | 0.1 |
| Cerebral Cortex | 0.5 | Lung ca. (large cell) NCI-H460 | 0.0 |
| Spinal cord | 0.0 | Lung ca. (non-sm. cell) A549 | 0.2 |
| glio/astro U87-MG | 0.0 | Lung ca. (non-s.cell) NCI-H23 | 0.0 |
| glio/astro U-118-MG | 0.0 | Lung ca. (non-s.cell) HOP-62 | 0.1 |
| astrocytoma SW1783 | 0.0 | Lung ca. (non-s.cl) NCI-H522 | 0.5 |
| neuro*; met SK-N-AS | 0.0 | Lung ca. (squam.) SW 900 | 3.1 |
| astrocytoma SF-539 | 0.0 | Lung ca. (squam.) NCI-H596 | 0.1 |
| astrocytoma SNB-75 | 0.0 | Mammary gland | 1.0 |
| glioma SNB-19 | 0.2 | Breast ca.* (pl.ef) MCF-7 | 0.2 |
| glioma U251 | 0.0 | Breast ca.* (pl.ef) MDA-MB-231 | 0.0 |
| glioma SF-295 | 0.1 | Breast ca.* (pl. ef) T47D | 5.4 |
| Heart | 1.3 | Breast ca. BT-549 | 0.0 |
| Skeletal Muscle | 0.8 | Breast ca. MDA-N | 0.0 |
| Bone marrow | 0.0 | Ovary | 0.0 |
| Thymus | 0.0 | Ovarian ca. OVCAR-3 | 0.9 |
| Spleen | 0.2 | Ovarian ca. OVCAR-4 | 0.2 |
| Lymph node | 0.0 | Ovarian ca. OVCAR-5 | 1.1 |
| Colorectal Tissue | 0.1 | Ovarian ca. OVCAR-8 | 0.0 |
| Stomach | 1.3 | Ovarian ca. IGROV-1 | 0.0 |

TABLE 37B-continued

Panel 1.2

| Tissue Name | Rel. Exp.(%) Ag1437, Run 138297722 | Tissue Name | Rel. Exp.(%) Ag1437, Run 138297722 |
| --- | --- | --- | --- |
| Small intestine | 0.2 | Ovarian ca. (ascites) SK-OV-3 | 0.1 |
| Colon ca. SW480 | 0.0 | Uterus | 0.1 |
| Colon ca.* SW620 (SW480 met) | 0.2 | Placenta | 0.0 |
| Colon ca. HT29 | 0.1 | Prostate | 3.7 |
| Colon ca. HCT-116 | 0.1 | Prostate ca.* (bone met) PC-3 | 0.0 |
| Colon ca. CaCo-2 | 4.9 | Testis | 0.0 |
| Colon ca. Tissue (ODO3866) | 0.0 | Melanoma Hs688(A).T | 0.0 |
| Colon ca. HCC-2998 | 2.7 | Melanoma* (met) Hs688(B).T | 0.0 |
| Gastric ca.* (liver met) NCI-N87 | 0.2 | Melanoma UACC-62 | 0.7 |
| Bladder | 15.4 | Melanoma M14 | 0.6 |
| Trachea | 0.0 | Melanoma LOX IMVI | 0.0 |
| Kidney | 100.0 | Melanoma* (met) SK-MEL-5 | 0.0 |
| Kidney (fetal) | 1.9 | | |

TABLE 37C

Panel 1.3D

| Tissue Name | Rel. Exp. (%) Ag1437, Run 146124971 | Rel. Exp. (%) Ag1437, Run 151531145 | Tissue Name | Rel. Exp. (%) Ag1437, Run 146124971 | Rel. Exp. (%) Ag1437, Run 151531145 |
| --- | --- | --- | --- | --- | --- |
| Liver adenocarcinoma | 0.0 | 0.0 | Kidney (fetal) | 26.8 | 28.5 |
| Pancreas | 34.4 | 67.4 | Renal ca. 786-0 | 0.0 | 0.0 |
| Pancreatic ca. CAPAN 2 | 0.0 | 0.0 | Renal ca. A498 | 0.9 | 1.4 |
| Adrenal gland | 0.4 | 2.0 | Renal ca. RXF 393 | 0.0 | 0.0 |
| Thyroid | 9.3 | 9.1 | Renal ca. ACHN | 0.4 | 0.0 |
| Salivary gland | 1.2 | 1.8 | Renal. ca. UO-31 | 0.0 | 0.0 |
| Pituitary gland | 5.3 | 6.0 | Renal ca. TK-10 | 0.3 | 0.6 |
| Brain (fetal) | 0.0 | 0.0 | Liver | 66.9 | 88.9 |
| Brain (whole) | 0.8 | 7.3 | Liver (fetal) | 66.0 | 100.0 |
| Brain (amygdala) | 2.7 | 0.0 | Liver ca. (hepatoblast) HepG2 | 100.0 | 90.8 |
| Brain (cerebellum) | 3.1 | 1.7 | Lung | 15.6 | 21.0 |
| Brain (hippocampus) | 4.6 | 14.5 | Lung (fetal) | 14.8 | 8.1 |
| Brain (substantia nigra) | 0.3 | 0.7 | Lung ca. (small cell) LX-1 | 1.2 | 1.8 |
| Brain (thalamus) | 1.4 | 3.7 | Lung ca. (small cell) NCI-H69 | 0.4 | 0.0 |
| Cerebral Cortex | 1.5 | 2.5 | Lung ca. (s.cell var.) SHP-77 | 0.7 | 3.2 |
| Spinal cord | 3.0 | 1.2 | Lung ca. (large cell)NCI-H460 | 0.0 | 0.0 |
| glio/astro U87-MG | 0.0 | 0.0 | Lung ca. (non-sm. cell) A549 | 0.4 | 0.0 |
| glio/astro U-118-MG | 0.4 | 0.0 | Lung ca. (non-s.cell) NCI-H23 | 0.0 | 0.0 |
| astrocytoma SW1783 | 0.0 | 0.0 | Lung ca. (non-s .cell) HOP-62 | 0.8 | 0.0 |

TABLE 37C-continued

Panel 1.3D

| Tissue Name | Rel. Exp. (%) Ag1437, Run 146124971 | Rel. Exp. (%) Ag1437, Run 151531145 | Tissue Name | Rel. Exp. (%) Ag1437, Run 146124971 | Rel. Exp. (%) Ag1437, Run 151531145 |
|---|---|---|---|---|---|
| neuro*; met SK-N-AS | 0.0 | 0.0 | Lung ca. (non-s.cl) NCI-H522 | 0.0 | 1.1 |
| astrocytoma SF-539 | 0.8 | 1.2 | Lung ca. (squam.) SW 900 | 9.4 | 8.0 |
| astrocytoma SNB-75 | 9.4 | 5.4 | Lung ca. (squam.) NCI-H596 | 0.0 | 0.0 |
| glioma SNB-19 | 0.2 | 0.0 | Mammary gland | 13.3 | 8.7 |
| glioma U251 | 0.0 | 0.0 | Breast ca.* (pl.ef) MCF-7 | 0.7 | 0.0 |
| glioma SF-295 | 0.3 | 0.6 | Breast ca.* (pl.ef) MDA-MB-231 | 0.7 | 0.0 |
| Heart (fetal) | 3.8 | 0.3 | Breast ca.* (pl.ef) T47D | 22.4 | 18.4 |
| Heart | 0.8 | 0.5 | Breast ca. BT-549 | 0.0 | 0.0 |
| Skeletal muscle (fetal) | 12.5 | 21.2 | Breast ca. MDA-N | 0.0 | 0.0 |
| Skeletal muscle | 1.6 | 0.0 | Ovary | 0.4 | 1.2 |
| Bone marrow | 0.7 | 0.0 | Ovarian ca. OVCAR-3 | 3.0 | 4.2 |
| Thymus | 0.0 | 0.7 | Ovarian ca. OVCAR-4 | 0.7 | 0.3 |
| Spleen | 3.1 | 5.1 | Ovarian ca. OVCAR-5 | 4.6 | 0.5 |
| Lymph node | 1.1 | 0.5 | Ovarian ca. OVCAR-8 | 0.4 | 0.0 |
| Colorectal | 2.6 | 2.4 | Ovarian ca. IGROV-1 | 0.0 | 0.0 |
| Stomach | 47.0 | 52.9 | Ovarian ca.* (ascites) SK-OV-3 | 0.4 | 0.0 |
| Small intestine | 2.0 | 0.0 | Uterus | 1.3 | 1.3 |
| Colon ca. SW480 | 0.3 | 0.6 | Placenta | 0.7 | 2.7 |
| Colon ca.* SW620(SW480 met) | 2.6 | 1.1 | Prostate | 6.1 | 11.7 |
| Colon ca. HT29 | 1.1 | 1.2 | Prostate ca.* (bone met)PC-3 | 0.0 | 0.0 |
| Colon ca. HCT-116 | 0.0 | 0.6 | Testis | 0.7 | 0.6 |
| Colon ca. CaCo-2 | 42.6 | 36.9 | Melanoma Hs688(A).T | 0.0 | 0.0 |
| Colon ca. tissue(ODO3866) | 0.0 | 0.3 | Melanoma* (met) Hs688(B).T | 0.0 | 0.0 |
| Colon ca. HCC-2998 | 7.8 | 7.8 | Melanoma UACC-62 | 0.3 | 0.0 |
| Gastric ca.* (liver met) NCI-N87 | 0.7 | 0.4 | Melanoma M14 | 1.4 | 1.0 |
| Bladder | 20.0 | 30.6 | Melanoma LOX IMVI | 0.0 | 0.0 |
| Trachea | 1.6 | 1.1 | Melanoma* (met) SK-MEL-5 | 0.0 | 0.0 |
| Kidney | 60.3 | 60.7 | Adipose | 2.7 | 0.0 |

TABLE 37D

Panel 2D

| Tissue Name | Rel. Exp. (%) Ag1437, Run 144872207 | Rel. Exp. (%) Ag1437, Run 145090527 | Tissue Name | Rel. Exp. (%) Ag1437, Run 144872207 | Rel. Exp. (%) Ag1437, Run 145090527 |
|---|---|---|---|---|---|
| Normal Colon | 1.3 | 1.0 | Kidney Margin 8120608 | 20.3 | 17.6 |
| CC Well to Mod Diff(ODO3866) | 0.2 | 0.2 | Kidney Cancer 8120613 | 16.5 | 7.2 |
| CC Margin (ODO3866) | 0.0 | 0.0 | Kidney Margin 8120614 | 20.3 | 16.3 |
| CC Gr.2 rectosigmoid (ODO3868) | 0.3 | 0.2 | Kidney Cancer 9010320 | 4.1 | 4.0 |
| CC Margin (ODO3868) | 0.2 | 0.0 | Kidney Margin 9010321 | 32.1 | 30.1 |
| CC Mod Diff (ODO3920) | 0.0 | 0.0 | Normal Uterus | 0.0 | 0.0 |
| CC Margin (ODO3920) | 0.0 | 0.0 | Uterus Cancer 064011 | 1.9 | 1.9 |
| CC Gr.2 ascend colon (ODO3921) | 0.0 | 0.0 | Normal Thyroid | 2.7 | 2.0 |
| CC Margin (ODO3921) | 1.0 | 0.0 | Thyroid Cancer 064010 | 2.4 | 3.2 |
| CC from Partial Hepatectomy (ODO4309) Mets | 1.5 | 1.3 | Thyroid Cancer A302152 | 5.3 | 8.4 |
| Liver Margin (ODO4309) | 30.4 | 22.7 | Thyroid Margin A302153 | 2.8 | 2.0 |
| Colon mets to lung (OD04451-01) | 0.5 | 0.5 | Normal Breast | 2.2 | 1.6 |
| Lung Margin (OD04451-02) | 1.0 | 0.7 | Breast Cancer (OD04566) | 11.1 | 11.0 |
| Normal Prostate 6546-1 | 5.1 | 5.4 | Breast Cancer (OD04590-01) | 15.8 | 14.3 |
| Prostate Cancer (OD04410) | 20.4 | 18.0 | Breast Cancer Mets (OD04590-03) | 25.7 | 52.5 |
| Prostate Margin (OD04410) | 1.5 | 2.0 | Breast Cancer Metastasis (OD04655-05) | 3.8 | 4.2 |
| Prostate Cancer (OD04720-01) | 8.5 | 7.4 | Breast Cancer 064006 | 3.2 | 4.1 |
| Prostate Margin (OD04720-02) | 2.4 | 2.5 | Breast Cancer 1024 | 7.1 | 5.3 |
| Normal Lung 061010 | 3.6 | 3.7 | Breast Cancer 9100266 | 10.7 | 11.0 |
| Lung Met to Muscle (ODO4286) | 0.0 | 0.3 | Breast Margin 9100265 | 2.8 | 4.2 |
| Muscle Margin (ODO4286) | 4.9 | 2.4 | Breast Cancer A209073 | 0.7 | 0.0 |
| Lung Malignant Cancer (OD03126) | 16.5 | 10.0 | Breast Margin A2090734 | 3.2 | 1.8 |
| Lung Margin (OD03126) | 3.6 | 3.3 | Normal Liver | 37.4 | 29.5 |
| Lung Cancer (OD04404) | 1.4 | 0.9 | Liver Cancer 064003 | 100.0 | 94.6 |
| Lung Margin (OD04404) | 3.2 | 2.9 | Liver Cancer 1025 | 41.5 | 32.8 |
| Lung Cancer (OD04565) | 0.8 | 1.0 | Liver Cancer 1026 | 9.9 | 9.7 |
| Lung Margin (OD04565) | 2.5 | 1.9 | Liver Cancer 6004-T | 87.1 | 100.0 |
| Lung Cancer (OD04237-01) | 2.1 | 2.7 | Liver Tissue 6004-N | 10.6 | 11.8 |
| Lung Margin (OD04237-02) | 1.8 | 1.6 | Liver Cancer 6005-T | 13.1 | 8.8 |

TABLE 37D-continued

Panel 2D

| Tissue Name | Rel. Exp. (%) Ag1437, Run 144872207 | Rel. Exp. (%) Ag1437, Run 145090527 | Tissue Name | Rel. Exp. (%) Ag1437, Run 144872207 | Rel. Exp. (%) Ag1437, Run 145090527 |
|---|---|---|---|---|---|
| Ocular Mel Met to Liver (ODO4310) | 2.1 | 1.8 | Liver Tissue 6005-N | 4.7 | 3.4 |
| Liver Margin (ODO4310) | 52.5 | 57.8 | Normal Bladder | 14.8 | 8.8 |
| Melanoma Mets to Lung (OD04321) | 1.7 | 0.8 | Bladder Cancer 1023 | 2.1 | 1.4 |
| Lung Margin (OD04321) | 4.7 | 4.1 | Bladder Cancer A302173 | 0.6 | 0.5 |
| Normal Kidney | 74.7 | 65.1 | Bladder Cancer (OD04718-01) | 0.0 | 0.0 |
| Kidney Ca, Nuclear grade 2 (OD04338) | 21.6 | 19.6 | Bladder Normal Adjacent (OD04718-03) | 0.3 | 0.7 |
| Kidney Margin (OD04338) | 18.6 | 17.1 | Normal Ovary | 0.1 | 0.2 |
| Kidney Ca Nuclear grade 1/2 (OD04339) | 25.0 | 28.1 | Ovarian Cancer 064008 | 2.9 | 3.8 |
| Kidney Margin (OD04339) | 73.7 | 67.4 | Ovarian Cancer (OD04768-07) | 0.3 | 0.5 |
| Kidney Ca, Clear cell type (OD04340) | 16.0 | 15.9 | Ovary Margin (OD04768-08) | 0.0 | 0.0 |
| Kidney Margin (OD04340) | 52.5 | 47.3 | Normal Stomach | 2.8 | 3.0 |
| Kidney Ca, Nuclear grade 3 (OD04348) | 0.1 | 0.0 | Gastric Cancer 9060358 | 0.0 | 0.0 |
| Kidney Margin (OD04348) | 30.6 | 35.1 | Stomach Margin 9060359 | 1.6 | 2.2 |
| Kidney Cancer (OD04622-01) | 2.2 | 2.8 | Gastric Cancer 9060395 | 0.0 | 0.0 |
| Kidney Margin (OD04622-03) | 8.0 | 5.1 | Stomach Margin 9060394 | 0.2 | 0.2 |
| Kidney Cancer (OD04450-01) | 10.4 | 10.9 | Gastric Cancer 9060397 | 0.2 | 0.2 |
| Kidney Margin (OD04450-03) | 18.2 | 19.5 | Stomach Margin 9060396 | 0.0 | 0.2 |
| Kidney Cancer 8120607 | 1.5 | 0.3 | Gastric Cancer 064005 | 0.0 | 0.5 |

TABLE 37E

Panel 4D

| Tissue Name | Rel. Exp.(%) Ag1437, Run 146424179 | Tissue Name | Rel. Exp.(%) Ag1437, Run 146424179 |
|---|---|---|---|
| Secondary Th1 act | 0.0 | HUVEC IL-1 beta | 0.0 |
| Secondary Th2 act | 0.0 | HUVEC IFN gamma | 1.2 |
| Secondary Tr1 act | 0.0 | HUVEC TNF alpha + IFN gamma | 0.2 |
| Secondary Th1 rest | 0.0 | HUVEC TNF alpha + IL4 | 0.0 |
| Secondary Th2 rest | 0.3 | HUVEC IL-11 | 0.0 |
| Secondary Tr1 rest | 0.0 | Lung Microvascular EC none | 0.0 |
| Primary Th1 act | 0.0 | Lung Microvascular EC TNFalpha + IL-1 beta | 0.0 |
| Primary Th2 act | 0.0 | Microvascular Dermal EC none | 0.0 |

TABLE 37E-continued

Panel 4D

| Tissue Name | Rel. Exp.(%) Ag1437, Run 146424179 | Tissue Name | Rel. Exp.(%) Ag1437, Run 146424179 |
|---|---|---|---|
| Primary Tr1 act | 0.0 | Microvascular Derman EC TNFalpha + IL-1 beta | 0.2 |
| Primary Th1 rest | 0.0 | Bronchial epithelium TNFalpha + IL1 beta | 0.0 |
| Primary Th2 rest | 0.0 | Small airway epithelium none | 0.0 |
| Primary Tr1 rest | 0.0 | Small airway epithelium TNFalpha + IL-1 beta | 0.0 |
| CD45RA CD4 lymphocyte act | 0.0 | Coronery artery SMC rest | 3.9 |
| CD45RO CD4 lymphocyte act | 0.2 | Coronery artery SMC TNFalpha + IL-1 beta | 0.0 |
| CD8 lymphocyte act | 0.0 | Astrocytes rest | 0.0 |
| Secondary CD8 lymphocyte rest | 0.0 | Astrocytes TNFalpha + IL-1 beta | 0.0 |
| Secondary CD8 lymphocyte act | 0.0 | KU-812 (Basophil) rest | 1.6 |
| CD4 lymphocyte none | 0.0 | KU-812 (Basophil) PMA/ionomycin | 3.0 |
| 2ry Th1/Th2/Tr1_anti-CD95 CH11 | 0.0 | CCD1106 (Keratinocytes) none | 0.0 |
| LAK cells rest | 0.0 | CCD1106 (Keratinocytes) TNFalpha + IL-1 beta | 0.0 |
| LAK cells IL-2 | 0.0 | Liver cirrhosis | 12.9 |
| LAK cells IL-2 + IL-12 | 0.0 | Lupus kidney | 5.6 |
| LAK cells IL-2 + IFN gamma | 0.2 | NCI-H292 none | 0.6 |
| LAK cells IL-2 + IL-18 | 0.0 | NCI-H292 IL-4 | 0.2 |
| LAK cells PMA/ionomycin | 0.0 | NCI-H292 IL-9 | 0.0 |
| NK Cells IL-2 rest | 0.0 | NCI-H292 IL-13 | 0.0 |
| Two Way MLR 3 day | 0.5 | NCI-H292 IFN gamma | 0.2 |
| Two Way MLR 5 day | 0.5 | HPAEC none | 0.4 |
| Two Way MLR 7 day | 0.0 | HPAEC TNF alpha + IL-1 beta | 0.2 |
| PBMC rest | 0.0 | Lung fibroblast none | 0.3 |
| PBMC PWM | 1.1 | Lung fibroblast TNF alpha + IL-1 beta | 0.0 |
| PBMC PHA-L | 0.6 | Lung fibroblast IL-4 | 0.0 |
| Ramos (B cell) none | 0.0 | Lung fibroblast IL-9 | 0.0 |
| Ramos (B cell) ionomycin | 0.0 | Lung fibroblast IL-13 | 0.2 |
| B lymphocytes PWM | 0.0 | Lung fibroblast IFN gamma | 0.0 |
| B lymphocytes CD40L and IL-4 | 0.0 | Dermal fibroblast CCD1070 rest | 0.0 |
| EOL-1 dbcAMP | 0.0 | Dermal fibroblast CCD1070 TNF alpha | 0.0 |
| EOL-1 dbcAMP PMA/ionomycin | 0.0 | Dermal fibroblast CCD1070 IL-1 beta | 0.0 |
| Dendritic cells none | 0.8 | Dermal fibroblast IFN gamma | 0.0 |
| Dendritic cells LPS | 4.6 | Dermal fibroblast IL-4 | 0.0 |
| Dendritic cells anti-CD40 | 0.4 | IBD Colitis 2 | 0.0 |
| Monocytes rest | 0.0 | IBD Crohn's | 0.0 |
| Monocytes LPS | 21.8 | Colon | 3.8 |
| Macrophages rest | 0.2 | Lung | 3.2 |
| Macrophages LPS | 1.6 | Thymus | 100.0 |
| HUVEC none | 0.2 | Kidney | 0.2 |
| HUVEC starved | 0.3 | | |

Panel 1.2 Summary: Ag1437 The expression of the CG56006-01 gene appears to be highest in a sample derived from normal adult kidney tissue (CT=23.3). In addition, there is substantial expression in samples derived from liver tissue. Of note is the difference in expression of this gene between adult and fetal kidney (CT=29) tissue. Thus, the expression of this gene could be uded to distinguish normal kidney tissue from other samples in the panel, and in particular, from fetal kidney tissue.

There are also moderate to high levels o expression of this putative hepsin in number of endocrine/metabolic related tissues including adrenal, GI track, kidney, liver, pancreas and skeletal muscle and thyroid. Therefore, a therapeutic modulator to this gene and/or gene product may prove useful in the treatment of diseases where these tissues are involved.

Panel 1.3D Summary: Ag1437 The expression of the CG56006-01 gene was assessed in two independent runs on panel 1.3D with excellent concordance between runs. The expression of this gene appears to be highest in samples derived from liver tissue. In addition, there is substantial expression associated with normal kidney, bladder, stomach and pancreas tissue. There is also substantial expression associated with cell lines derived from liver cancer, breast cancer and colon cancer. Thus, the expression of this gene could be used to distiguish liver derived samples from other samples in the panel. Moreover, therapeutic modulation of this gene, through the use of small molecule drugs, protein therapeutic or antibodies may be useful in the treatment of colon cancer, breast cancer or liver cancer.

In addition this gene expressed at much higher levels in fetal (CTs=33) when compared to adult skeletal muscle (CTs=36–40). This observation suggest that expression of this gene can be used to distinguish fetal from adult skeletal muscle. In addition, the relative overexpression of this gene in fetal skeletal muscle suggests that the protein product may enhance muscular growth or development in the fetus and thus may also act in a regenerative capacity in the adult. Therefore, therapeutic modulation of the protein encoded by this gene could be useful in treatment o muscle related diseases. More specifically, treatment of weak or dystrophic muscle with the protein encoded by this gene could restore muscle mass or function.

Panel2D Summary: Ag1437 The expression of the CG56006-01 gene was assessed in two independent runs on panel 2D with excellent concordance between runs. The expression of this gene appears to be highest in samples derived from liver tissue, in particular malignant liver. This expression is consistent with the expression seen in Panel 1.3D. In addition, there is substantial expression associated with normal kidney tissues, when compared to their malignant counterparts, and breast and prostate concers. Thus the expression of this gene could be used to distinguish liver derived samples from other samples in the panel, Moreover, therapeutic modulation of this gene, through the use of small molecule drugs, protein therapeutics or antibodies may be useful in the treatment of liver cancer, kidney cancer, breast cancer or prostate cancer.

References:
Magee J A, Araki T, Patil S, Ehrig T, True L, Humphrey P A, Catalona W J, Watson M A, Milbrandt J. Expression profiling reveals hepsin overexpression in prostate cancer. Cancer Res 2001 Aug. 1; 61(15):5692–6

Prostate cancer is the most commonly diagnosed noncutaneous cancer in men. Despite this fact, many of the genetic changes that coincide with prostate cancer progression remain enigmatic. We have addressed this problem by characterizing the expression profiles of several benign and malignant human prostate samples, and we have identified several genes that are differentially expressed between benign and malignant glands. One gene that was overexpressed encodes the serine protease hepsin. We used an independent sample set to confirm that hepsin is overexpressed in prostate tumors, and in situ hybridization demonstrates that hepsin is specifically overexpressed in the carcinoma cells themselves. These facts, together with the molecular properties of hepsin, make it an ideal target for prostate cancer therapy.

PMID: 11479199

Panel 4D Summary: Ag1437 The CG56006-01 transcript is expressed almost exclusively in activated monocytes at low but significant levels. This transcript encodes a serine protease hepsin, a transmembrane protease which has implicated in cell growth and maintenance. The expression of this transcript in LPS treated monocytes, cells that play a crucial role in linking innate immunity to adaptive immunity, suggests a role for this gene product in initiating inflammatory reactions. Therefore, modulation of the expression or activity of this gene through the application of monoclonal antibodies may reduce or prevent early stages of inflammation and reduce the severity of inflammatory diseases such as psoriasis, asthma, inflammatory bowel disease, rheumatoid arthritis, osteoarthritis and other lung inflammatory diseases.

NOV2 (CG56149-01)

Expression of gene CG56149-01 was assessed using the primer-probe sets Ag1672, Ag1673 and Ag3263, described in Tables 38A, 38B and 38C. Results of the, RTQ-PCR runs are shown in Table 38D.

TABLE 38A

PROBE NAME Ag1672

| Primers | Sequences | | Length | Start Position |
|---|---|---|---|---|
| Forward | 5'-gaccaaactttggccatttaa-3' | (SEQ ID NO:210) | 21 | 1568 |
| Probe | TET-5'-cggatccatttgacacaccagcattt-3'-TAMRA | (SEQ ID NO:211) | 26 | 1589 |
| Reverse | 5'-gtgatggtcagagcatgaattt-3' | (SEQ ID NO:212) | 22 | 1646 |

TABLE 38B

PROBE NAME Ag1673

| Primers | Sequences | | Length | Start Position |
|---|---|---|---|---|
| Forward | 5'-gaccaaactttggccatttaa-3' | (SEQ ID NO:213) | 21 | 1568 |
| Probe | TET-5'-cggatccatttgacacaccagcattt-3'-TAMRA | (SEQ ID NO:214) | 26 | 1589 |
| Reverse | 5'-gtgatggtcagagcatgaattt-3' | (SEQ ID NO:215) | 22 | 1646 |

TABLE 38C

PROBE NAME Ag3263

| Primers | Sequences | | Length | Start Position |
|---|---|---|---|---|
| Forward | 5'-tggggtagttggagctgaa-3' | (SEQ ID NO:216) | 19 | 876 |
| Probe | TET-5'-caggtctgcacctgttcagcatttg-3'-TAMRA | (SEQ ID NO:217) | 25 | 897 |
| Reverse | 5'-tgcagacagaactgtgtcagtt-3' | (SEQ ID NO:218) | 22 | 954 |

TABLE 38D

Panel 1.3D

| Tissue Name | Rel. Exp. (%) Ag1672, Run 147227540 | Rel. Exp. (%) Ag1673, Run 146581465 | Tissue Name | Rel. Exp. (%) Ag1672, Run 147227540 | Rel. Exp. (%) Ag1673, Run 146581465 |
|---|---|---|---|---|---|
| Liver adenocarcinoma | 41.8 | 36.6 | Kidney (fetal) | 12.2 | 14.9 |
| Pancreas | 5.3 | 7.4 | Renal ca. 786-0 | 18.2 | 18.3 |
| Pancreatic ca. CAPAN 2 | 9.5 | 9.1 | Renal ca. A498 | 47.6 | 55.1 |
| Adrenal gland | 13.3 | 16.6 | Renal ca. RXF 393 | 6.8 | 9.9 |
| Thyroid | 16.8 | 18.6 | Renal ca. ACHN | 37.1 | 41.2 |
| Salivary gland | 12.3 | 10.7 | Renal ca. UO-31 | 37.1 | 39.0 |
| Pituitary gland | 24.5 | 31.6 | Renal ca.TK-10 | 27.7 | 43.8 |
| Brain (fetal) | 8.2 | 9.7 | Liver | 0.0 | 5.6 |
| Brain (whole) | 25.7 | 26.8 | Liver (fetal) | 24.7 | 31.2 |
| Brain (amygdala) | 20.0 | 21.5 | Liver ca. (hepatoblast) HepG2 | 27.9 | 31.6 |
| Brain (cerebellum) | 8.7 | 9.2 | Lung | 12.2 | 14.6 |
| Brain (hippocampus) | 41.2 | 37.4 | Lung (fetal) | 32.3 | 32.3 |
| Brain (substantia nigra) | 7.2 | 9.0 | Lung ca. (small cell) LX-1 | 21.5 | 34.6 |
| Brain (thalamus) | 9.3 | 20.7 | Lung ca. (small cell) NCI-H69 | 29.5 | 35.6 |
| Cerebral Cortex | 33.7 | 39.2 | Lung ca. (s.cell var.) SHP-77 | 61.6 | 61.6 |
| Spinal cord | 15.5 | 19.2 | Lung ca. (large cell)NCI-H460 | 29.9 | 33.9 |
| glio/astro U87-MG | 44.8 | 52.1 | Lung ca. (non-sm. cell) A549 | 16.8 | 15.2 |
| glio/astro U-118-MG | 100.0 | 89.5 | Lung ca. (non-s.cell) NCI-H23 | 79.0 | 92.7 |
| astrocytoma SW1783 | 29.5 | 45.1 | Lung ca. (non-s.cell) HOP-62 | 36.6 | 41.2 |
| neuro*; met SK-N-AS | 64.6 | 67.4 | Lung ca. (non-s.cl) NCI-H522 | 30.8 | 37.9 |
| astrocytoma SF-539 | 33.2 | 34.4 | Lung ca. (squam.) SW 900 | 15.7 | 19.5 |
| astrocytoma SNB-75 | 84.7 | 80.7 | Lung ca. (squam.) NCI-H596 | 15.0 | 15.8 |
| glioma SNB-19 | 30.1 | 43.2 | Mammary gland | 27.5 | 40.6 |
| glioma U251 | 32.8 | 41.5 | Breast ca.* (pl.ef) MCF-7 | 46.7 | 42.9 |
| glioma SF-295 | 35.8 | 43.5 | Breast ca.* (pl.ef) MDA-MB-231 | 84.7 | 86.5 |
| Heart (fetal) | 17.0 | 18.3 | Breast ca.* (pl.ef) T47D | 36.3 | 34.4 |

TABLE 38D-continued

Panel 1.3D

| Tissue Name | Rel. Exp. (%) Ag1672, Run 147227540 | Rel. Exp. (%) Ag1673, Run 146581465 | Tissue Name | Rel. Exp. (%) Ag1672, Run 147227540 | Rel. Exp. (%) Ag1673, Run 146581465 |
|---|---|---|---|---|---|
| Heart | 10.7 | 11.6 | Breast ca. BT-549 | 94.0 | 80.1 |
| Skeletal muscle (fetal) | 49.0 | 44.4 | Breast ca. MDA-N | 27.7 | 29.5 |
| Skeletal muscle | 55.1 | 57.8 | Ovary | 9.6 | 11.2 |
| Bone marrow | 18.3 | 23.5 | Ovarian ca. OVCAR-3 | 21.6 | 23.0 |
| Thymus | 21.3 | 21.0 | Ovarian ca. OVCAR-4 | 9.3 | 9.2 |
| Spleen | 14.8 | 20.0 | Ovarian ca. OVCAR-5 | 37.1 | 34.6 |
| Lymph node | 18.7 | 21.2 | Ovarian ca. OVCAR-8 | 45.4 | 44.8 |
| Colorectal | 7.0 | 10.4 | Ovarian ca. IGROV-1 | 13.2 | 16.4 |
| Stomach | 25.9 | 28.9 | Ovarian ca.* (ascites) SK-OV-3 | 66.4 | 63.7 |
| Small intestine | 13.5 | 15.7 | Uterus | 17.3 | 18.6 |
| Colon ca. SW480 | 52.5 | 50.0 | Placenta | 37.9 | 37.1 |
| Colon ca.* SW620(SW480 met) | 19.3 | 21.8 | Prostate | 9.3 | 11.5 |
| Colon ca. HT29 | 21.9 | 33.2 | Prostate ca.* (bone met)PC-3 | 23.8 | 35.8 |
| Colon ca. HCT-116 | 35.4 | 29.9 | Testis | 87.1 | 84.1 |
| Colon ca. CaCo-2 | 32.3 | 35.4 | Melanoma Hs688(A).T | 55.5 | 57.8 |
| Colon ca. tissue(ODO3866) | 25.7 | 29.3 | Melanoma* (met) Hs688(B).T | 74.7 | 88.9 |
| Colon ca. HCC-2998 | 44.1 | 44.8 | Melanoma UACC-62 | 3.0 | 3.8 |
| Gastric ca.* (liver met) NCI-N87 | 95.3 | 100.0 | Melanoma M14 | 7.4 | 11.9 |
| Bladder | 9.9 | 11.8 | Melanoma LOX IMVI | 3.3 | 4.4 |
| Trachea | 23.5 | 30.8 | Melanoma* (met) SK-MEL-5 | 13.4 | 18.8 |
| Kidney | 5.6 | 3.8 | Adipose | 12.4 | 13.8 |

Panel 1.3D Summary: Ag1672/Ag1673 Two experiments with the same probe and primer set produce results that are in excellent agreement with highest expression of the CG56149-01 gene in a gastric cancer cell line (NCI-N87) or a brain cancer cell line (U-118-MG)(CTs=26–27). Thus, the expression of this gene could be used to distinguish these samples from other samples in the panel.

This gene encodes a protein that is homologous to nardilysin, an N-arginine (R) dibasic (NRD) convertase metalloendopeptidase of the M16 family, that specifically cleaves peptide substrates at the N-terminus of arginines in dibasic motifs in vitro. The peptidase M16 family is also known as the insulinase family and nardilysin is the closest homolog of the insulin degrading enzyme, insulinase. The ability of nardilysin to degrade insulin has not been proven. However, the high levels of expression in metabolic tissues in this panel, including adipose, fetal and adult skeletal muscle, pancreas, adrenal, thyroid and pituitary glands suggest that this gene product may have a profound effect on limiting the degradation of insulin in tissues relevant to type II diabetes (e.g. adipose, skeletal muscle).

There is also a significant level of difference between expression in adult (CTs=31–40) and fetal liver tissue (CTs=28), making this gene and/or gene-product a good candidate for distinguishing both forms. A putative role for this gene-product is in the post-translational processing of bioactive peptides from their inactive precursors.

This gene is also highly expressed in the testis. Nardilysis has been implicated in spermiogenesis. Thus, expression of this gene could be used as a marker for testis tissue. Furthermore, therapeutic modulation of the expression or function of this gene may be useful in the treatment of male reproductive disorders. A third experiment with the probe and primer set Ag3263 shows low/undetectable levels of expression in all the samples on this panel. (CTs>35). (Data not shown.)

References:

Hospital V, Chesneau V, Balogh A, Joulie C, Seidah N G, Cohen P, Prat A. N-arginine dibasic convertase (nardilysin) isoforms are soluble dibasic-specific metalloendopeptidases that localize in the cytoplasm and at the cell surface. Biochem J 2000 Jul. 15; 349(Pt 2):587–97

N-arginine (R) dibasic (NRD) convertase (nardilysin; EC 3.4.24.61), a metalloendopeptidase of the M16 family, specifically cleaves peptide substrates at the N-terminus of arginines in dibasic motifs in vitro. In rat testis, the enzyme localizes within the cytoplasm of spermatids and associates with microtubules of the manchette and axoneme. NRD1 and NRD2 convertases, two NRD convertase isoforms, differ by the absence (isoform 1) or presence (isoform 2) of a 68-amino acid insertion close to the active site. In this study, we overexpressed both isoforms, either by vaccinia virus infection of BSC40 cells or transfection of COS-7 cells. The partially purified enzymes exhibit very similar biochemical and enzymic properties. Microsequencing revealed that NRD convertase is N-terminally processed. Results of immunocytofluorescence, immunoelectron microscopy and subcellular fractionation studies argue in favour of a primary cytosolic localization of both peptidases. Although the putative signal peptide did not direct NRD convertase into microsomes in an in vitro translation assay, biotinylation experiments clearly showed the presence of both isoforms at the cell surface. In conclusion, although most known processing events at pairs of basic residues are achieved by proprotein convertases within the secretory pathway, NRD convertase may fulfil a similar function in the cytoplasm and/or at the cell surface.

PMID: 10880358

Hospital V, Prat A, Joulie C, Cherif D, Day R, Cohen P. Human and rat testis express two mRNA species encoding variants of NRD convertase, a metalloendopeptidase of the insulinase family. Biochem J 1997 Nov. 1; 327 (Pt 3):773–9

Rat testis NRD convertase (EC 3.4.24.61) is a Zn2+ dependent endopeptidase that cleaves, in vitro, peptide substrates at the N-terminus of Arg residues in dibasic sites. This putative processing enzyme of the insulinase family of metallopeptidases exhibits a significant degree of similarity to insulinase and two yeast processing enzymes, Axl1 and Ste23. We report the cloning of two human testis cDNA species encoding isoforms of NRD convertase, hNRD1 and hNRD2. Whereas the hNRD1 transcript (3.7 kb) is equivalent to the previously characterized rat cDNA (rNRD1), hNRD2 and rNRD2 are 3.9 kb novel forms containing a nucleotide insertion encoding a 68-residue segment. This motif, which is inserted N-terminal of the Zn2+binding site, HXXEH, is contained within the most conserved region among the insulinase family members. Analysis of the deduced primary sequences revealed 92% identity between rat and human orthologues. The human gene encoding NRD convertase was localized to chromosome 1p32.1–p32.2. Whereas NRD convertase is mostly expressed in testis and in 24 cell lines, low mRNA levels were detected in most of the 27 other tissues tested.

PMID: 9581555

Chesneau V, Prat A, Segretain D, Hospital V, Dupaix A, Foulon T, Jegou B, Cohen P. NRD convertase: a putative processing endoprotease associated with the axoneme and the manchette in late spermatids.

J Cell Sci 1996 November; 109 (Pt 11):2737–45

N-arginine dibasic convertase is a novel metalloendopeptidase which selectively cleaves at the N terminus of arginine residues in paired basic amino acids. Although present in brain and several other tissues, NRD convertase is particularly abundant in testis, where its expression appeared to be restricted to germ cells. Low levels of both mRNA and its corresponding protein were detected early in spermatogenesis. However, a marked accumulation of the protein was observed during late steps (14 to 19) of spermatogenesis. By electron microscopy, the NRD convertase immunoreactivity was localized in the cytoplasm of elongating and elongated spermatids, with a noticeable concentration at the level of two microtubular structures, i.e. the manchette and the axoneme. These observations strongly support the hypothesis that NRD convertase is involved in processing events potentially associated with the morphological transformations occurring during spermiogenesis.

PMID: 8937991

Panel 5D Summary: Ag3263 Expression of the CG56149-01 gene is low/undetectable in all samples on this panel (CTs>35). (Data not shown).

NOV5 (CG56151-01)

Expression of gene CG56151-01 was assessed using the primer-probe set Ag1681, described in Table 39A. Results of the RTQ-PCR runs are shown in Tables 39B, 39C, 39D and 39E.

TABLE 39A

PROBE NAME Ag1681

| Primers | Sequences | | Length | Start Position |
|---|---|---|---|---|
| Forward | 5'-ggacttctgtggaccttatgtg-3' | (SEQ ID NO:219) | 22 | 1412 |
| Probe | TET-5'-ttttcctctttgctggagtgctcctg-3'-TAMRA | (SEQ ID NO:220) | 26 | 1435 |
| Reverse | 5'-ttcctttggtttctggaactttt-3' | (SEQ ID NO:221) | 22 | 1485 |

TABLE 39B

General_screening_panel_v1.4

| Tissue Name | Rel. Exp.(%) Ag1681, Run 208016706 | Tissue Name | Rel. Exp.(%) Ag1681, Run 208016706 |
|---|---|---|---|
| Adipose | 0.0 | Renal ca. TK-10 | 0.1 |
| Melanoma* Hs688(A).T | 0.0 | Bladder | 0.4 |
| Melanoma* Hs688(B).T | 0.0 | Gastric ca. (liver met.) NCI-N87 | 0.7 |
| Melanoma* M14 | 0.2 | Gastric ca. KATO III | 0.1 |
| Melanoma* LOXIMVI | 0.2 | Colon ca. SW-948 | 0.0 |

TABLE 39B-continued

General_screening_panel_v1.4

| Tissue Name | Rel. Exp.(%) Ag1681, Run 208016706 | Tissue Name | Rel. Exp.(%) Ag1681, Run 208016706 |
|---|---|---|---|
| Melanoma* SK-MEL-5 | 0.0 | Colon ca. SW480 | 0.2 |
| Squamous cell carcinoma SCC-4 | 0.0 | Colon ca.* (SW480 met) SW620 | 0.0 |
| Testis Pool | 0.4 | Colon ca. HT29 | 0.1 |
| Prostate ca.* (bone met) PC-3 | 0.0 | Colon ca. HCT-116 | 0.1 |
| Prostate Pool | 0.0 | Colon ca. CaCo-2 | 3.7 |
| Placenta | 0.0 | Colon cancer tissue | 0.0 |
| Uterus Pool | 0.0 | Colon ca. SW1116 | 0.0 |
| Ovarian ca. OVCAR-3 | 0.4 | Colon ca. Colo-205 | 0.1 |
| Ovarian ca. SK-OV-3 | 0.0 | Colon ca. SW-48 | 0.0 |
| Ovarian ca. OVCAR-4 | 0.0 | Colon Pool | 0.0 |
| Ovarian ca. OVCAR-5 | 0.1 | Small Intestine Pool | 0.0 |
| Ovarian ca. IGROV-1 | 0.0 | Stomach Pool | 0.2 |
| Ovarian ca. OVCAR-8 | 0.1 | Bone Marrow Pool | 0.0 |
| Ovary | 0.2 | Fetal Heart | 0.0 |
| Breast ca. MCF-7 | 0.2 | Heart Pool | 0.1 |
| Breast ca. MDA-MB-231 | 0.0 | Lymph Node Pool | 0.1 |
| Breast ca. BT 549 | 0.0 | Fetal Skeletal Muscle | 0.1 |
| Breast ca. T47D | 0.1 | Skeletal Muscle Pool | 0.0 |
| Breast ca. MDA-N | 0.2 | Spleen Pool | 0.1 |
| Breast Pool | 0.1 | Thymus Pool | 0.0 |
| Trachea | 0.0 | CNS cancer (glio/astro) U87-MG | 0.0 |
| Lung | 0.1 | CNS cancer (glio/astro) U-118-MG | 0.0 |
| Fetal Lung | 1.2 | CNS cancer (neuro;met) SK-N-AS | 0.0 |
| Lung ca. NCI-N417 | 0.0 | CNS cancer (astro) SF-539 | 0.0 |
| Lung ca. LX-1 | 0.1 | CNS cancer (astro) SNB-75 | 0.1 |
| Lung ca. NCI-H146 | 0.0 | CNS cancer (glio) SNB-19 | 0.0 |
| Lung ca. SHP-77 | 0.0 | CNS cancer (glio) SF-295 | 0.0 |
| Lung ca. A549 | 0.0 | Brain (Amygdala) Pool | 0.2 |
| Lung ca. NCI-H526 | 0.0 | Brain (cerebellum) | 0.0 |
| Lung ca. NCI-H23 | 0.2 | Brain (fetal) | 0.0 |
| Lung ca. NCI-H460 | 0.0 | Brain (Hippocampus) Pool | 0.1 |
| Lung ca. HOP-62 | 0.6 | Cerebral Cortex Pool | 0.2 |
| Lung ca. NCI-H522 | 0.0 | Brain (Substantia nigra) Pool | 0.4 |
| Liver | 23.2 | Brain (Thalamus) Pool | 0.1 |
| Fetal Liver | 100.0 | Brain (whole) | 0.4 |
| Liver ca. HepG2 | 7.4 | Spinal Cord Pool | 0.3 |
| Kidney Pool | 0.1 | Adrenal Gland | 0.1 |
| Fetal Kidney | 1.9 | Pituitary gland Pool | 0.1 |
| Renal ca. 786-0 | 0.6 | Salivary Gland | 0.0 |
| Renal ca. A498 | 0.1 | Thyroid (female) | 0.0 |
| Renal ca. ACHN | 4.8 | Pancreatic ca. CAPAN2 | 0.5 |
| Renal ca. UO-31 | 0.1 | Pancreas Pool | 0.5 |

TABLE 39C

Panel 1.3D

| Tissue Name | Rel. Exp.(%) Ag1681, Run 146581527 | Tissue Name | Rel. Exp.(%) Ag1681, Run 146581527 |
|---|---|---|---|
| Liver adenocarcinoma | 0.0 | Kidney (fetal) | 5.8 |
| Pancreas | 1.5 | Renal ca. 786-0 | 0.5 |
| Pancreatic ca. CAPAN 2 | 0.3 | Renal ca. A498 | 0.5 |
| Adrenal gland | 0.1 | Renal ca. RXF 393 | 0.1 |

TABLE 39C-continued

Panel 1.3D

| Tissue Name | Rel. Exp.(%) Ag1681, Run 146581527 | Tissue Name | Rel. Exp.(%) Ag1681, Run 146581527 |
|---|---|---|---|
| Thyroid | 0.0 | Renal ca. ACHN | 11.7 |
| Salivary gland | 0.0 | Renal ca. UO-31 | 0.2 |
| Pituitary gland | 0.2 | Renal ca. TK-10 | 0.1 |
| Brain (fetal) | 0.0 | Liver | 100.0 |
| Brain (whole) | 0.0 | Liver (fetal) | 99.3 |
| Brain (amygdala) | 0.0 | Liver ca. (hepatoblast) HepG2 | 22.2 |
| Brain (cerebellum) | 0.0 | Lung | 0.0 |
| Brain (hippocampus) | 0.1 | Lung (fetal) | 0.0 |
| Brain (substantia nigra) | 0.0 | Lung ca. (small cell) LX-1 | 0.0 |
| Brain (thalamus) | 0.0 | Lung ca. (small cell) NCI-H69 | 0.0 |
| Cerebral Cortex | 0.1 | Lung ca. (s.cell var.) SHP-77 | 0.0 |
| Spinal cord | 0.1 | Lung ca. (large cell)NCI-H460 | 0.0 |
| glio/astro U87-MG | 0.2 | Lung ca. (non-sm. cell) A549 | 0.1 |
| glio/astro U-118-MG | 0.0 | Lung ca. (non-s.cell) NCI-H23 | 0.7 |
| astrocytoma SW1783 | 0.2 | Lung ca. (non-s.cell) HOP-62 | 0.5 |
| neuro*; met SK-N-AS | 0.1 | Lung ca. (non-s.cl) NCI-H522 | 0.0 |
| astrocytoma SF-539 | 0.2 | Lung ca. (squam.) SW 900 | 0.1 |
| astrocytoma SNB-75 | 0.0 | Lung ca. (squam.) NCI-H596 | 0.0 |
| glioma SNB-19 | 0.1 | Mammary gland | 0.0 |
| glioma U251 | 0.0 | Breast ca.* (pl.ef) MCF-7 | 0.2 |
| glioma SF-295 | 0.0 | Breast ca.* (pl.ef) MDA-MB-231 | 0.2 |
| Heart (fetal) | 0.0 | Breast ca.* (pl.ef) T47D | 0.2 |
| Heart | 0.0 | Breast ca. BT-549 | 0.0 |
| Skeletal muscle (fetal) | 0.0 | Breast ca. MDA-N | 0.4 |
| Skeletal muscle | 0.0 | Ovary | 0.1 |
| Bone marrow | 0.0 | Ovarian ca. OVCAR-3 | 0.3 |
| Thymus | 0.0 | Ovarian ca. OVCAR-4 | 0.1 |
| Spleen | 0.0 | Ovarian ca. OVCAR-5 | 0.2 |
| Lymph node | 0.0 | Ovarian ca. OVCAR-8 | 0.2 |
| Colorectal | 0.3 | Ovarian ca. IGROV-1 | 0.0 |
| Stomach | 0.1 | Ovarian ca.* (ascites) SK-OV-3 | 0.0 |
| Small intestine | 7.6 | Uterus | 0.0 |
| Colon ca. SW480 | 0.3 | Placenta | 0.0 |
| Colon ca.* SW620(SW480 met) | 0.0 | Prostate | 0.0 |
| Colon ca. HT29 | 0.2 | Prostate ca.* (bone met)PC-3 | 0.0 |
| Colon ca. HCT-116 | 0.0 | Testis | 0.2 |
| Colon ca. CaCo-2 | 8.8 | Melanoma Hs688(A).T | 0.0 |
| Colon ca. tissue(ODO3866) | 0.1 | Melanoma* (met) Hs688(B).T | 0.1 |
| Colon ca. HCC-2998 | 1.7 | Melanoma UACC-62 | 0.0 |
| Gastric ca.* (liver met) NCI-N87 | 0.8 | Melanoma M14 | 0.2 |
| Bladder | 0.4 | Melanoma LOX IMVI | 0.0 |
| Trachea | 0.0 | Melanoma* (met) SK-MEL-5 | 0.0 |
| Kidney | 8.9 | Adipose | 0.1 |

TABLE 39D

Panel 2D

| Tissue Name | Rel. Exp.(%) Ag1681, Run 148168295 | Tissue Name | Rel. Exp.(%) Ag1681, Run 148168295 |
|---|---|---|---|
| Normal Colon | 0.5 | Kidney Margin 8120608 | 1.7 |
| CC Well to Mod Diff (ODO3866) | 0.0 | Kidney Cancer 8120613 | 0.0 |
| CC Margin (ODO3866) | 0.0 | Kidney Margin 8120614 | 2.2 |
| CC Gr.2 rectosigmoid (ODO3868) | 0.0 | Kidney Cancer 9010320 | 0.1 |
| CC Margin (ODO3868) | 0.0 | Kidney Margin 9010321 | 4.0 |
| CC Mod Diff (ODO3920) | 0.1 | Normal Uterus | 0.0 |
| CC Margin (ODO3920) | 0.0 | Uterus Cancer 064011 | 0.0 |
| CC Gr.2 ascend colon (ODO3921) | 0.0 | Normal Thyroid | 0.1 |
| CC Margin (ODO3921) | 0.0 | Thyroid Cancer 064010 | 0.2 |
| CC from Partial Hepatectomy (ODO4309) Mets | 6.6 | Thyroid Cancer A302152 | 0.1 |
| Liver Margin (ODO4309) | 100.0 | Thyroid Margin A302153 | 0.1 |
| Colon mets to lung (OD04451-01) | 0.0 | Normal Breast | 0.1 |
| Lung Margin (OD04451-02) | 0.0 | Breast Cancer (OD04566) | 0.1 |
| Normal Prostate 6546-1 | 0.0 | Breast Cancer (OD04590-01) | 0.0 |
| Prostate Cancer (OD04410) | 0.0 | Breast Cancer Mets (OD04590-03) | 0.1 |
| Prostate Margin (OD04410) | 0.0 | Breast Cancer Metastasis (OD04655-05) | 0.0 |
| Prostate Cancer (OD04720-01) | 0.0 | Breast Cancer 064006 | 0.5 |
| Prostate Margin (OD04720-02) | 0.0 | Breast Cancer 1024 | 0.0 |
| Normal Lung 061010 | 0.1 | Breast Cancer 9100266 | 0.0 |
| Lung Met to Muscle (ODO4286) | 0.0 | Breast Margin 9100265 | 0.0 |
| Muscle Margin (ODO4286) | 0.0 | Breast Cancer A209073 | 0.1 |
| Lung Malignant Cancer (OD03126) | 0.0 | Breast Margin A2090734 | 0.1 |
| Lung Margin (OD03126) | 0.0 | Normal Liver | 86.5 |
| Lung Cancer (OD04404) | 0.0 | Liver Cancer 064003 | 23.5 |
| Lung Margin (OD04404) | 0.0 | Liver Cancer 1025 | 39.8 |
| Lung Cancer (OD04565) | 0.0 | Liver Cancer 1026 | 13.6 |
| Lung Margin (OD04565) | 0.0 | Liver Cancer 6004-T | 47.0 |
| Lung Cancer (OD04237-01) | 0.0 | Liver Tissue 6004-N | 8.1 |
| Lung Margin (OD04237-02) | 0.0 | Liver Cancer 6005-T | 12.6 |
| Ocular Mel Met to Liver (ODO4310) | 0.0 | Liver Tissue 6005-N | 14.1 |
| Liver Margin (ODO4310) | 62.0 | Normal Bladder | 0.3 |
| Melanoma Mets to Lung (OD04321) | 0.0 | Bladder Cancer 1023 | 0.0 |
| Lung Margin (OD04321) | 0.0 | Bladder Cancer A302173 | 0.0 |
| Normal Kidney | 9.2 | Bladder Cancer (OD04718-01) | 0.0 |
| Kidney Ca, Nuclear grade 2 (OD04338) | 1.0 | Bladder Normal Adjacent (OD04718-03) | 0.0 |
| Kidney Margin (OD04338) | 1.5 | Normal Ovary | 0.0 |
| Kidney Ca Nuclear grade 1/2 (OD04339) | 0.0 | Ovarian Cancer 064008 | 0.0 |
| Kidney Margin (OD04339) | 12.9 | Ovarian Cancer (OD04768-07) | 0.8 |
| Kidney Ca, Clear cell type (OD04340) | 10.4 | Ovary Margin (OD04768-08) | 0.0 |
| Kidney Margin (OD04340) | 3.7 | Normal Stomach | 0.0 |

TABLE 39D-continued

Panel 2D

| Tissue Name | Rel. Exp.(%) Ag1681, Run 148168295 | Tissue Name | Rel. Exp.(%) Ag1681, Run 148168295 |
|---|---|---|---|
| Kidney Ca, Nuclear grade 3 (OD04348) | 0.3 | Gastric Cancer 9060358 | 0.0 |
| Kidney Margin (OD04348) | 2.1 | Stomach Margin 9060359 | 0.0 |
| Kidney Cancer (OD04622-01) | 1.0 | Gastric Cancer 9060395 | 0.0 |
| Kidney Margin (OD04622-03) | 0.5 | Stomach Margin 9060394 | 0.3 |
| Kidney Cancer (OD04450-01) | 0.4 | Gastric Cancer 9060397 | 0.0 |
| Kidney Margin (OD04450-03) | 2.2 | Stomach Margin 9060396 | 0.0 |
| Kidney Cancer 8120607 | 0.0 | Gastric Cancer 064005 | 0.4 |

TABLE 39E

Panel 5D

| Tissue Name | Rel. Exp.(%) Ag1681, Run 169271477 | Tissue Name | Rel. Exp.(%) Ag1681, Run 169271477 |
|---|---|---|---|
| 97457_Patient-02go_adipose | 0.2 | 94709_Donor 2 AM - A_adipose | 0.0 |
| 97476_Patient-07sk_skeletal muscle | 0.0 | 94710_Donor 2 AM - B_adipose | 0.0 |
| 97477_Patient-07ut_uterus | 0.0 | 94711_Donor 2 AM - C_adipose | 0.0 |
| 97478_Patient-07pl_placenta | 0.0 | 94712_Donor 2 AD - A_adipose | 0.0 |
| 97481_Patient-08sk_skeletal muscle | 0.0 | 94713_Donor 2 AD - B_adipose | 0.0 |
| 97482_Patient-08ut_uterus | 0.0 | 94714_Donor 2 AD - C_adipose | 0.0 |
| 97483_Patient-08pl_placenta | 0.2 | 94742 Donor 3 U - A_Mesenchymal Stem Cells | 0.0 |
| 97486_Patient-09sk_skeletal muscle | 0.0 | 94743_Donor 3 U - B_Mesenchymal Stem Cells | 0.0 |
| 97487_Patient-09ut_uterus | 0.1 | 94730_Donor 3 AM - A_adipose | 0.0 |
| 97488_Patient-09pl_placenta | 0.0 | 94731_Donor 3 AM - B_adipose | 0.0 |
| 97492_Patient-10ut_uterus | 0.0 | 94732_Donor 3 AM - C_adipose | 0.0 |
| 97493_Patient-10pl_placenta | 0.0 | 94733_Donor 3 AD - A_adipose | 0.0 |
| 97495_Patient-11go_adipose | 0.0 | 94734_Donor 3 AD - B_adipose | 0.0 |
| 97496_Patient-11sk_skeletal muscle | 0.0 | 94735_Donor 3 AD - C_adipose | 0.0 |
| 97497_Patient-11ut_uterus | 0.0 | 77138_Liver_HepG2untreated | 28.3 |
| 97498_Patient-11pl_placenta | 0.0 | 73556_Heart_Cardiac stromal cells (primary) | 0.0 |
| 97500_Patient-12go_adipose | 0.3 | 81735_Small Intestine | 12.3 |
| 97501_Patient-12sk_skeletal muscle | 0.0 | 72409_Kidney_Proximal Convoluted Tubule | 4.3 |
| 97502_Patient-12ut_uterus | 0.2 | 82685_Small intestine_Duodenum | 100.0 |
| 97503_Patient-12pl_placenta | 0.0 | 90650_Adrenal_Adrenocortical adenoma | 0.0 |
| 94721_Donor 2 U - A_Mesenchymal Stem Cells | 0.0 | 72410_Kidney_HRCE | 3.6 |
| 94722_Donor 2 U - B_Mesenchymal Stem Cells | 0.0 | 72411_Kidney_HRE | 0.1 |

TABLE 39E-continued

Panel 5D

| Tissue Name | Rel. Exp.(%) Ag1681, Run 169271477 | Tissue Name | Rel. Exp.(%) Ag1681, Run 169271477 |
| --- | --- | --- | --- |
| 94723_Donor 2 U - C_Mesenchymal Stem Cells | 0.0 | 73139_Uterus_Uterine smooth muscle cells | 0.0 |

General_screening_panel_v1.4 Summary: Ag1681 The CG56151-01 gene, a glucose transporter type 2 homolog, is predominantly expressed in liver. GLUT2 facilitates the transport of glucose into the liver. This gene is also expressed in brain, pancreas, and testis. This is consistent with immunocytochemistry data that shows that the Glut2 gene is expressed in insulin producing beta cells in the pancreas and aids in regulation of insulin secretion. Since the liver is responsible for gluconeogenesis, enhancing glucose uptake through GLUT2 may produce a negative feedback loop that would decrease hepatic glucose production. This could result in a lowering of blood glucose, a major therapeutic goal for the treatment of Type II (non-insulin dependent) diabetes. Thus, enhancing the function of the protein encoded by the CG56151-01 gene with an agonist antibody therapeutic could restore balance to blood glucose levels in patients with Type II diabetes.

In addition, this gene is expressed at higher levels in fetal liver and lung (CTs=29) than in the adult sources of these tissues. Thus, expression of this gene could be used to differentiate between the two sources of these tissues.

References:

Waeber G, Pedrazzini T, Bonny 0, Bonny C, Steinmann M, Nicod P, Haefliger J A. A 338-bp proximal fragment of the glucose transporter type 2 (GLUT2) promoter drives reporter gene expression in the pancreatic islets of transgenic mice. Mol Cell Endocrinol 1995 Oct. 30; 114(1–2):205–15

The high Km glucose transporter GLUT2 is a membrane protein expressed in tissues involved in maintaining glucose homeostasis, and in cells where glucose-sensing is necessary. In many experimental models of diabetes, GLUT2 gene expression is decreased in pancreatic beta-cells, which could lead to a loss of glucose-induced insulin secretion. In order to identify factors involved in pancreatic beta-cell specific expression of GLUT2, we have recently cloned the murine GLUT2 promoter and identified cis-elements within the 338-bp of the proximal promoter capable of binding islet-specific trans-acting factors. Furthermore, in transient transfection studies, this 338-bp fragment could efficiently drive the expression of the chloramphenicol acetyl transferase (CAT) gene in cell lines derived from the endocrine pancreas, but displayed no promoter activity in non-pancreatic cells. In this report, we tested the cell-specific expression of a CAT reporter gene driven by a short (338 bp) and a larger (1311 bp) fragment of the GLUT2 promoter in transgenic mice. We generated ten transgenic lines that integrated one of the constructs. CAT mRNA expression in transgenic tissues was assessed using the RNAse protection assay and the quantitative reverse transcribed polymerase chain reaction (RT-PCR). Overall CAT mRNA expression for both constructs was low compared to endogenous GLUT2 mRNA levels but the reporter transcript could be detected in all animals in the pancreatic islets and the liver, and in a few transgenic lines in the kidney and the small intestine. The CAT protein was also present in Langerhans islets and in the liver for both constructs by immunocytochemistry. These findings suggest that the proximal 338 bp of the murine GLUT2 promoter contain cis-elements required for the islet-specific expression of GLUT2.

PMID: 8674846

Panel 1.3D Summary: Ag1681 Expression of the CG56151-01 gene is restricted to liver derived tissue, an important metabolic tissue, in this panel (CTs=27). This liver specific expression is consistent with expression in other panels and with published data (see reference below.) Thus, expression of this gene could be used as a marker for liver tissue. This gene encodes a glut2 homolog. Please see General_screening_panel_v1.4 for discussion of utility of this gene in metabolic disease.

References:

Rencurel F, Waeber G, Antoine B, Rocchiccioli F, Maulard P, Girard J, Leturque A. Requirement of glucose metabolism for regulation of glucose transporter type 2 (GLUT2) gene expression in liver. Biochem J 1996 Mar. 15; 314 (Pt 3):903–9

Previous studies have shown that glucose increases the glucose transporter (GLUT2) mRNA expression in the liver in vivo and in vitro. Here we report an analysis of the effects of glucose metabolism on GLUT2 gene expression. GLUT2 mRNA accumulation by glucose was not due to stabilization of its transcript but rather was a direct effect on gene transcription. A proximal fragment of the 5' regulatory region of the mouse GLUT2 gene linked to a reporter gene was transiently transfected into liver GLUT2-expressing cells. Glucose stimulated reporter gene expression in these cells, suggesting that glucose-responsive elements were included within the proximal region of the promoter. A dose-dependent effect of glucose on GLUT2 expression was observed over 10 mM glucose irrespective of the hexokinase isozyme (glucokinase K(m) 16 mM; hexokinase I K(m) 0.01 mM) present in the cell type used. This suggests that the correlation between extracellular glucose and GLUT2 mRNA concentrations is simply a reflection of an activation of glucose metabolism. The mediators and the mechanism responsible for this response remain to be determined. In conclusion, glucose metabolism is required for the proper induction of the GLUT2 gene in the liver and this effect is transcriptionally regulated.

PMID: 8615787

Panel 2D Summary: Ag1681 The expression of the CG56151-01 gene appears to be highest in a sample of normal liver tissue adjacent to a colon cancer metastasis (CT=24.6). In addition, there is substantial expression in both normal and malignant liver tissue. This restricted pattern of expression in liver derived tissue is consistent with expression in the previous panels. Thus, the expression of this gene could be used to distinguish liver derived tissue from other samples in the panel. Moreover, therapeutic modulation of this gene, through the use of small molecule drugs, protein therapeutics or antibodies might be beneficial in the treatment of liver cancer.

Panel 5D Summary: Ag1681 The expression pattern of the CG56151-01 gene, a Glut2 homolog, is limited to a liver cell line (HepG2) and small intestines. The presence of this isoform in the intestines may indicate an important role in glucose uptake from the digestive tract. Please refer to panel 1.4 for a further discussion of utility of this gene in metabolic disease.

NOV3 (CG56155-01)

Expression of gene CG56155-01 was assessed using the primer-probe set Ag1688, described in Table 40A. Results of the RTQ-PCR runs are shown in Tables 40B, 40C and 40D.

TABLE 40A

PROBE NAME Ag1688

| Primers | Sequences | | Length | Start Position |
|---|---|---|---|---|
| Forward | 5'-tcagaagggaatcatgatatcg-3' | (SEQ ID NO:222) | 22 | 1503 |
| Probe | TET-5'-ccttgataaaactccaggctcctttga-3'-TAMRA | (SEQ ID NO:223) | 27 | 1525 |
| Reverse | 5'-tttggaaggtaggcatattgg-3' | (SEQ ID NO:224) | 21 | 1572 |

TABLE 40B

Panel 1.3D

| Tissue Name | Rel. Exp.(%) Ag1688, Run 147249266 | Tissue Name | Rel. Exp.(%) Ag1688, Run 147249266 |
|---|---|---|---|
| Liver adenocarcinoma | 0.0 | Kidney (fetal) | 9.2 |
| Pancreas | 6.7 | Renal ca. 786-0 | 0.0 |
| Pancreatic ca. CAPAN 2 | 0.2 | Renal ca. A498 | 1.7 |
| Adrenal gland | 1.8 | Renal ca. RXF 393 | 0.0 |
| Thyroid | 3.8 | Renal ca. ACHN | 0.0 |
| Salivary gland | 1.5 | Renal ca. UO-31 | 0.0 |
| Pituitary gland | 6.1 | Renal ca. TK-10 | 0.0 |
| Brain (fetal) | 0.5 | Liver | 100.0 |
| Brain (whole) | 3.6 | Liver (fetal) | 99.3 |
| Brain (amygdala) | 3.3 | Liver ca. (hepatoblast) HepG2 | 0.0 |
| Brain (cerebellum) | 0.4 | Lung | 1.3 |
| Brain (hippocampus) | 6.2 | Lung (fetal) | 1.8 |
| Brain (substantia nigra) | 1.0 | Lung ca. (small cell) LX-1 | 0.0 |
| Brain (thalamus) | 2.1 | Lung ca. (small cell) NCI-H69 | 0.0 |
| Cerebral Cortex | 6.3 | Lung ca. (s.cell var.) SHP-77 | 0.8 |
| Spinal cord | 3.1 | Lung ca. (large cell) NCI-H460 | 0.0 |
| glio/astro U87-MG | 0.0 | Lung ca. (non-sm. cell) A549 | 0.2 |
| glio/astro U-118-MG | 0.0 | Lung ca. (non-s.cell) NCI-H23 | 0.0 |
| astrocytoma SW1783 | 0.0 | Lung ca. (non-s.cell) HOP-62 | 0.0 |
| neuro*; met SK-N-AS | 0.2 | Lung ca. (non-s.cl) NCI-H522 | 0.0 |
| astrocytoma SF-539 | 0.0 | Lung ca. (squam.) SW 900 | 0.2 |
| astrocytoma SNB-75 | 0.1 | Lung ca. (squam.) NCI-H596 | 0.0 |
| glioma SNB-19 | 0.2 | Mammary gland | 2.9 |
| glioma U251 | 1.2 | Breast ca.* (pl.ef) MCF-7 | 0.0 |
| glioma SF-295 | 0.0 | Breast ca.* (pl.ef) MDA-MB-231 | 0.0 |
| Heart (fetal) | 0.2 | Breast ca.* (pl.ef) T47D | 0.0 |
| Heart | 1.6 | Breast ca. BT-549 | 0.0 |
| Skeletal muscle (fetal) | 0.7 | Breast ca. MDA-N | 0.0 |
| Skeletal muscle | 1.2 | Ovary | 0.0 |
| Bone marrow | 0.5 | Ovarian ca. OVCAR-3 | 0.2 |
| Thymus | 3.2 | Ovarian ca. OVCAR-4 | 0.0 |
| Spleen | 1.0 | Ovarian ca. OVCAR-5 | 0.3 |
| Lymph node | 2.9 | Ovarian ca. OVCAR-8 | 0.0 |
| Colorectal | 0.8 | Ovarian ca. IGROV-1 | 0.0 |
| Stomach | 3.3 | Ovarian ca.* (ascites) SK-OV-3 | 1.0 |

TABLE 40B-continued

Panel 1.3D

| Tissue Name | Rel. Exp.(%) Ag1688, Run 147249266 | Tissue Name | Rel. Exp.(%) Ag1688, Run 147249266 |
|---|---|---|---|
| Small intestine | 6.2 | Uterus | 1.4 |
| Colon ca. SW480 | 0.0 | Placenta | 0.4 |
| Colon ca.* SW620 (SW480 met) | 0.0 | Prostate | 1.0 |
| Colon ca. HT29 | 0.0 | Prostate ca.* (bone met) PC-3 | 0.0 |
| Colon ca. HCT-116 | 0.0 | Testis | 6.1 |
| Colon ca. CaCo-2 | 0.2 | Melanoma Hs688(A).T | 0.4 |
| Colon ca. tissue (ODO3866) | 0.0 | Melanoma* (met) Hs688(B).T | 0.9 |
| Colon ca. HCC-2998 | 0.2 | Melanoma UACC-62 | 0.0 |
| Gastric ca.* (liver met) NCI-N87 | 4.4 | Melanoma M14 | 0.0 |
| Bladder | 3.1 | Melanoma LOX IMVI | 0.0 |
| Trachea | 3.0 | Melanoma* (met) SK-MEL-5 | 0.0 |
| Kidney | 6.8 | Adipose | 0.5 |

TABLE 40C

Panel 2D

| Tissue Name | Rel. Exp.(%) Ag1688, Run 162646059 | Tissue Name | Rel. Exp.(%) Ag1688, Run 162646059 |
|---|---|---|---|
| Normal Colon | 1.7 | Kidney Margin 8120608 | 0.7 |
| CC Well to Mod Diff (ODO3866) | 0.0 | Kidney Cancer 8120613 | 0.0 |
| CC Margin (ODO3866) | 0.2 | Kidney Margin 8120614 | 0.5 |
| CC Gr.2 rectosigmoid (ODO3868) | 0.2 | Kidney Cancer 9010320 | 0.2 |
| CC Margin (ODO3868) | 0.1 | Kidney Margin 9010321 | 1.0 |
| CC Mod Diff (ODO3920) | 0.1 | Normal Uterus | 0.2 |
| CC Margin (ODO3920) | 0.9 | Uterus Cancer 064011 | 0.8 |
| CC Gr.2 ascend colon (ODO3921) | 0.1 | Normal Thyroid | 0.9 |
| CC Margin (ODO3921) | 0.1 | Thyroid Cancer 064010 | 0.2 |
| CC from Partial Hepatectomy (ODO4309) Mets | 4.7 | Thyroid Cancer A302152 | 0.5 |
| Liver Margin (ODO4309) | 100.0 | Thyroid Margin A302153 | 1.0 |
| Colon mets to lung (OD04451-01) | 0.1 | Normal Breast | 0.3 |
| Lung Margin (OD04451-02) | 0.1 | Breast Cancer (OD04566) | 0.1 |
| Normal Prostate 6546-1 | 2.1 | Breast Cancer (OD04590-01) | 0.1 |
| Prostate Cancer (OD04410) | 0.6 | Breast Cancer Mets (OD04590-03) | 0.4 |
| Prostate Margin (OD04410) | 0.5 | Breast Cancer Metastasis (OD04655-05) | 0.9 |
| Prostate Cancer (OD04720-01) | 1.1 | Breast Cancer 064006 | 0.6 |
| Prostate Margin (OD04720-02) | 1.6 | Breast Cancer 1024 | 1.2 |
| Normal Lung 061010 | 2.0 | Breast Cancer 9100266 | 0.1 |
| Lung Met to Muscle (ODO4286) | 0.0 | Breast Margin 9100265 | 0.1 |
| Muscle Margin (ODO4286) | 0.2 | Breast Cancer A209073 | 0.3 |
| Lung Malignant Cancer (OD03126) | 0.1 | Breast Margin A2090734 | 0.3 |

TABLE 40C-continued

Panel 2D

| Tissue Name | Rel. Exp.(%) Ag1688, Run 162646059 | Tissue Name | Rel. Exp.(%) Ag1688, Run 162646059 |
|---|---|---|---|
| Lung Margin (OD03126) | 0.5 | Normal Liver | 69.7 |
| Lung Cancer (OD04404) | 0.1 | Liver Cancer 064003 | 13.7 |
| Lung Margin (OD04404) | 0.2 | Liver Cancer 1025 | 18.0 |
| Lung Cancer (OD04565) | 0.0 | Liver Cancer 1026 | 1.2 |
| Lung Margin (OD04565) | 0.1 | Liver Cancer 6004-T | 22.2 |
| Lung Cancer (OD04237-01) | 0.1 | Liver Tissue 6004-N | 1.0 |
| Lung Margin (OD04237-02) | 0.4 | Liver Cancer 6005-T | 1.9 |
| Ocular Mel Met to Liver (ODO4310) | 0.1 | Liver Tissue 6005-N | 4.2 |
| Liver Margin (ODO4310) | 77.4 | Normal Bladder | 2.7 |
| Melanoma Mets to Lung (OD04321) | 0.0 | Bladder Cancer 1023 | 0.0 |
| Lung Margin (OD04321) | 0.1 | Bladder Cancer A302173 | 0.2 |
| Normal Kidney | 12.9 | Bladder Cancer (OD04718-01) | 0.1 |
| Kidney Ca, Nuclear grade 2 (OD04338) | 3.8 | Bladder Normal Adjacent (OD04718-03) | 0.5 |
| Kidney Margin (OD04338) | 1.6 | Normal Ovary | 0.0 |
| Kidney Ca Nuclear grade 1/2 (OD04339) | 2.8 | Ovarian Cancer 064008 | 0.1 |
| Kidney Margin (OD04339) | 9.3 | Ovarian Cancer (OD04768-07) | 0.2 |
| Kidney Ca, Clear cell type (OD04340) | 1.4 | Ovary Margin (OD04768-08) | 0.1 |
| Kidney Margin (OD04340) | 4.1 | Normal Stomach | 0.3 |
| Kidney Ca, Nuclear grade 3 (OD04348) | 0.1 | Gastric Cancer 9060358 | 0.1 |
| Kidney Margin (OD04348) | 3.8 | Stomach Margin 9060359 | 0.0 |
| Kidney Cancer (OD04622-01) | 0.2 | Gastric Cancer 9060395 | 0.2 |
| Kidney Margin (OD04622-03) | 0.7 | Stomach Margin 9060394 | 0.3 |
| Kidney Cancer (OD04450-01) | 0.2 | Gastric Cancer 9060397 | 0.3 |
| Kidney Margin (OD04450-03) | 2.6 | Stomach Margin 9060396 | 0.0 |
| Kidney Cancer 8120607 | 0.0 | Gastric Cancer 064005 | 1.1 |

TABLE 40D

Panel 5 Islet

| Tissue Name | Rel. Exp.(%) Ag1688, Run 226587524 | Tissue Name | Rel. Exp.(%) Ag1688, Run 226587524 |
|---|---|---|---|
| 97457_Patient-02go_adipose | 41.2 | 94709_Donor 2 AM - A_adipose | 0.0 |
| 97476_Patient-07sk_skeletal muscle | 9.9 | 94710_Donor 2 AM - B_adipose | 0.0 |
| 97477_Patient-07ut_uterus | 8.1 | 94711_Donor 2 AM - C_adipose | 0.0 |
| 97478_Patient-07pl_placenta | 0.0 | 94712_Donor 2 AD - A_adipose | 11.4 |
| 99167_Bayer Patient 1 | 84.7 | 94713_Donor 2 AD - B_adipose | 0.0 |
| 97482_Patient-08ut_uterus | 2.4 | 94714_Donor 2 AD - C_adipose | 29.1 |
| 97483_Patient-08pl_placenta | 0.0 | 94742_Donor 3 U - A_Mesenchymal Stem Cells | 19.2 |
| 97486_Patient-09sk_skeletal muscle | 8.0 | 94743_Donor 3 U - B_Mesenchymal Stem Cells | 0.0 |
| 97487_Patient-09ut_uterus | 9.6 | 94730_Donor 3 AM - A_adipose | 15.0 |

TABLE 40D-continued

Panel 5 Islet

| Tissue Name | Rel. Exp.(%) Ag1688, Run 226587524 | Tissue Name | Rel. Exp.(%) Ag1688, Run 226587524 |
|---|---|---|---|
| 97488_Patient-09pl_placenta | 0.0 | 94731_Donor 3 AM - B_adipose | 37.9 |
| 97492_Patient-10ut_uterus | 0.0 | 94732_Donor 3 AM - C_adipose | 0.0 |
| 97493_Patient-10pl_placenta | 0.0 | 94733_Donor 3 AD - A_adipose | 39.2 |
| 97495_Patient-11go_adipose | 0.0 | 94734_Donor 3 AD - B_adipose | 11.4 |
| 97496_Patient-11sk_skeletal muscle | 52.9 | 94735_Donor 3 AD - C_adipose | 34.4 |
| 97497_Patient-11ut_uterus | 35.8 | 77138_Liver_HepG2untreated | 8.4 |
| 97498_Patient-11pl_placenta | 10.5 | 73556_Heart_Cardiac stromal cells (primary) | 0.0 |
| 97500_Patient-12go_adipose | 0.0 | 81735_Small Intestine | 100.0 |
| 97501_Patient-12sk_skeletal muscle | 35.4 | 72409_Kidney_Proximal Convoluted Tubule | 9.9 |
| 97502_Patient-12ut_uterus | 20.7 | 82685_Small intestine_Duodenum | 70.2 |
| 97503_Patient-12pl_placenta | 0.0 | 90650_Adrenal_Adrenocortical adenoma | 25.5 |
| 94721_Donor 2 U - A_Mesenchymal Stem Cells | 0.0 | 72410_Kidney_HRCE | 10.4 |
| 94722_Donor 2 U - B_Mesenchymal Stem Cells | 0.0 | 72411_Kidney_HRE | 7.2 |
| 94723_Donor 2 U - C_Mesenchymal Stem Cells | 0.0 | 73139_Uterus_Uterine smooth muscle cells | 0.0 |

Panel 1.3D Summary: Ag1688 Expression of the CG56155-01 gene, a plasma kallikrein homolog, is significantly higher in liver (CTs=28) than in any other sample on this panel. Thus, expression of this gene could be used as a marker of liver tissue. Plasma kallikrein is a serine protease that, among other roles, plays a part in blood coagulation, fibrinolysis, and complement activation and has been implicated in adipose differentiation by remodelling of the fibronectin-rich ECM of preadipocytes. Therefore, an antagonist to this gene product may be beneficial in the treatment of obesity.

References:

Hoover-Plow J, Yuen L. Plasminogen binding is increased with adipocyte differentiation. Biochem.Biophys.Res.Commun. (2001) 284, 389–394

The purpose of this study was to examine the role of the plasminogen system in the development of adipose tissue. Plasminogen binding capacity was determined in differentiated and undifferentiated cells from adipose tissue of plasminogen deficient mice and 3T3 cells, a well-characterized tissue culture model. In 3T3 cells, plasminogen binding was fivefold higher in differentiated cells compared to the undifferentiated cells. Inhibition of binding by carboxyl-terminal lysine analogs was similar for the differentiated and undifferentiated cells with tranexamic acid>EACA>lysine. The binding of plasminogen was concentration-dependent and approaches saturation in the both cell types. The number of plasminogen binding sites was tenfold higher in the differentiated compared to the undifferentiated cells. In isolated mature fat cells and stromal cell cultures from mouse adipose tissue, plasminogen binding was also higher in the differentiated mature fat cells and differentiated stromal cells compared to undifferentiated stromal cells. Plasminogen binding was elevated in the differentiated cells from the Plg−/− mice compared to cells from the WT mice. These results suggest that the plasminogen system plays an important role in adipose tissue development. Copyright 2001 Academic Press.

PMID: 11394891

Selvarajan S, Lund L R, Takeuchi T, Craik C S, Werb Z. A plasma kallikrein-dependent plasminogen cascade required for adipocyte differentiation. Nature Cell Biol. (2001) 3, 267–275.

Here we show that plasma kallikrein (PKal) mediates a plasminogen (Plg) cascade in adipocyte differentiation. Ecotin, an inhibitor of serine proteases, inhibits cell-shape change, adipocyte-specific gene expression, and lipid accumulation during adipogenesis in culture. Deficiency of Plg, but not of urokinase or tissue-type plasminogen activator, suppresses adipogenesis during differentiation of 3T3-LI cells and mammary-gland involution. PKal, which is inhibited by ecotin, is required for adipose conversion, Plg activation and 3T3-L1 differentiation. Human plasma lacking PKal does not support differentiation of 3T3-L1 cells. PKal is therefore a physiological regulator that acts in the Plg cascade during adipogenesis. We propose that the Plg cascade fosters adipocyte differentiation by degradation of the fibronectin-rich preadipocyte stromal matrix.

PMID: 11231576

Panel 2D Summary: Ag1688 The expression of the CG56155-01 gene appears to be highest in a sample derived from a sample of normal liver tissue adjacent to a metastatic colon cancer CT=26.2). In addition, there is substantial expression in other samples of normal liver, and to a much lesser degree, malignant liver tissue. This liver specific expression is consistent with the expression seen in Panel 1.3D. Thus, the expression of this gene could be used to distinguish liver derived tissue from the toher samples in the panel, and more specifically the expression of this gene could be used to distinguish normal liver from malignant liver tissue. Moreover, therapeutic modulation of this gene, through the use of small molecule drugs, protein therapeutics or antibodies might be of benefit in the treatment of liver cancer.

Panel 5 Islet Summary: Ag1688 Expression of the CG56155-01 gene is limited to pancreatic islets and small intestines. Please see Panel 1.3 for discussion of utility of this gene in metabolic disease.

Example 3

SNP Analysis of SECX and/or NOVX Clones

SeqCallingTM Technology: cDNA was derived from various human samples representing multiple tissue types, normal and diseased states, physiological states, and developmental states from different donors. Samples were obtained as whole tissue, cell lines, primary cells or tissue cultured primary cells and cell lines. Cells and cell lines may have been treated with biological or chemical agents that regulate gene expression for example, growth factors, chemokines, steroids. The cDNA thus derived was then sequenced using CuraGen's proprietary SeqCalling technology. Sequence traces were evaluated manually and edited for corrections if appropriate. cDNA sequences from all samples were assembled with themselves and with public ESTs using bioinformatics programs to generate CuraGen's human SeqCalling database of SeqCalling assemblies. Each assembly contains one or more overlapping cDNA sequences derived from one or more human samples. Fragments and ESTs were included as components for an assembly when the extent of identity with another component of the assembly was at least 95% over 50 bp. Each assembly can represent a gene and/or its variants such as splice forms and/or single nucleotide polymorphisms (SNPs) and their combinations.

Variant sequences are included in this application. A variant sequence can include a single nucleotide polymorphism (SNP). A SNP can, in some instances, be referred to as a "cSNP" to denote that the nucleotide sequence containing the SNP originates as a cDNA. A SNP can arise in several ways. For example, a SNP may be due to a substitution of one nucleotide for another at the polymorphic site. Such a substitution can be either a transition or a transversion. A SNP can also arise from a deletion of a nucleotide or an insertion of a nucleotide, relative to a reference allele. In this case, the polymorphic site is a site at which one allele bears a gap with respect to a particular nucleotide in another allele. SNPs occurring within genes may result in an alteration of the amino acid encoded by the gene at the position of the SNP. Intragenic SNPs may also be silent, however, in the case that a codon including a SNP encodes the same amino acid as a result of the redundancy of the genetic code. SNPs occurring outside the region of a gene, or in an intron within a gene, do not result in changes in any amino acid sequence of a protein but may result in altered regulation of the expression pattern for example, alteration in temporal expression, physiological response regulation, cell type expression regulation, intensity of expression, stability of transcribed message.

Method of novel SNP Identification: SNPs are identified by analyzing sequence assemblies using CuraGen's proprietary SNPTool algorithm. SNPTool identifies variation in assemblies with the following criteria: SNPs are not analyzed within 10 base pairs on both ends of an alignment; Window size (number of bases in a view) is 10; The allowed number of mismatches in a window is 2; Minimum SNP base quality (PHRED score) is 23; Minimum number of changes to score an SNP is 2/assembly position. SNPTool analyzes the assembly and displays SNP positions, associated individual variant sequences in the assembly, the depth of the assembly at that given position, the putative assembly allele frequency, and the SNP sequence variation. Sequence traces are then selected and brought into view for manual validation. The consensus assembly sequence is imported into CuraTools along with variant sequence changes to identify potential amino acid changes resulting from the SNP sequence variation. Comprehensive SNP data analysis is then exported into the SNPCalling database.

Method of novel SNP Confirmation: SNPs are confirmed employing a validated method know as Pyrosequencing (Pyrosequencing, Westborough, Mass.). Detailed protocols for Pyrosequencing can be found in: Alderborn et al. Determination of Single Nucleotide Polymorphisms by Real-time Pyrophosphate DNA Sequencing. (2000). *Genome Research*. 10, Issue 8, August. 1249–1265. In brief, Pyrosequencing is a real time primer extension process of genotyping. This protocol takes double-stranded, biotinylated PCR products from genomic DNA samples and binds them to streptavidin beads. These beads are then denatured producing single stranded bound DNA. SNPs are characterized utilizing a technique based on an indirect bioluminometric assay of pyrophosphate (PPi) that is released from each dNTP upon DNA chain elongation. Following Klenow polymerase-mediated base incorporation, PPi is released and used as a substrate, together with adenosine 5'-phosphosulfate (APS), for ATP sulfurylase, which results in the formation of ATP. Subsequently, the ATP accomplishes the conversion of luciferin to its oxi-derivative by the action of luciferase. The ensuing light output becomes proportional to the number of added bases, up to about four bases. To allow processivity of the method dNTP excess is degraded by apyrase, which is also present in the starting reaction mixture, so that only dNTPs are added to the template during the sequencing. The process has been fully automated and adapted to a 96-well format, which allows rapid screening of large SNP panels. The DNA and protein sequences for the novel single nucleotide polymorphic variants are reported. Variants are reported individually but any combination of all or a select subset of variants are also included. In addition, the positions of the variant bases and the variant amino acid residues are underlined.

Results

Variants are reported individually but any combination of all or a select subset of variants are also included as contemplated SECX and/or NOVX embodiments of the invention SEC1 SNP Data:

SEC1 has five SNP variants, whose variant positions for its nucleotide and amino acid sequences is numbered according to SEQ ID NOs:1 and 2, respectively. The nucleotide sequences of the SEC1 variant differs as shown in Table 41.

TABLE 41 cSNP and Coding Variants for SEC1

| NT Position of cSNP | Wild Type NT | Variant NT | Amino acid position | Amino acid change |
|---|---|---|---|---|
| 468 | T | C | 130 | Cys > Arg |
| 513 | T | C | 145 | Cys > Arg |
| 585 | A | T | 169 | Lys > Glu |
| 619 | G | A | 180 | Gly > Asp |
| 1050 | A | G | 324 | Thr > Ala |

SEC2 SNP Data:

SEC2 has two SNP variants, whose variant positions for its nucleotide and amino acid sequences is numbered according to SEQ ID NOs:3 and 4, respectively. The nucleotide sequence of the SEC2 variant differs as shown in Table 42.

TABLE 42 cSNP and Coding Variants for SEC2

| NT Position of cSNP | Wild Type NT | Variant NT | Amino acid position | Amino acid change |
|---|---|---|---|---|
| 1894 | G | A | 599 | Val > Met |
| 2055 | A | G | Silent | Silent |

SEC4 SNP Data:

SEC4 has three SNP variants, whose variant positions for its nucleotide and amino acid sequences is numbered according to SEQ ID NOs:7 and 8, respectively. The nucleotide sequence of the SEC3 variant differs as shown in Table 43.

TABLE 43 cSNP and Coding Variants for SEC4

| NT Position of cSNP | Wild Type NT | Variant NT | Amino acid position | Amino acid change |
|---|---|---|---|---|
| 80 | T | C | 11 | Leu > Pro |
| 383 | T | C | 112 | Ile > Thr |
| 482 | A | G | 145 | Asn > Ser |

SEC5 SNP Data:

SEC5 has one SNP variant, whose variant positions for its nucleotide and amino acid sequences is numbered according to SEQ ID NOs:9 and 10, respectively. The nucleotide sequence of the SEC5 variant differs as shown in Table 44.

TABLE 44 cSNP and Coding Variants for SEC5

| NT Position of cSNP | Wild Type NT | Variant NT | Amino acid position | Amino acid change |
|---|---|---|---|---|
| 861 | G | A | Silent | Silent |

SEC7 SNP Data:

SEC7 has one SNP variant, whose variant positions for its nucleotide and amino acid sequences is numbered according to SEQ ID NOs:13 and 14, respectively. The nucleotide sequence of the SEC7 variant differs as shown in Table 45.

TABLE 45 cSNP and Coding Variants for SEC7

| NT Position of cSNP | Wild Type NT | Variant NT | Amino acid position | Amino acid change |
|---|---|---|---|---|
| 2673 | T | C | Silent | Silent |

SEC10 SNP Data:

SEC10 has two SNP variants, whose variant positions for its nucleotide and amino acid sequences is numbered according to SEQ ID NOs:19 and 20, respectively. The nucleotide sequence of the SEC10 variant differs as shown in Table 46.

TABLE 46 cSNP and Coding Variants for SEC10

| NT Position of cSNP | Wild Type NT | Variant NT | Amino acid position | Amino acid change |
|---|---|---|---|---|
| 746 | G | A | 234 | Val > Ile |
| 999 | C | T | Silent | Silent |

SEC12 SNP Data:

SEC12 has four SNP variants, whose variant positions for its nucleotide and amino acid sequences is numbered according to SEQ ID NOs:23 and 24, respectively. The nucleotide sequence of the SEC12 variant differs as shown in Table 47.

TABLE 47 cSNP and Coding Variants for SEC12

| NT Position of cSNP | Wild Type NT | Variant NT | Amino acid position | Amino acid change |
|---|---|---|---|---|
| 824 | G | A | Silent | Silent |
| 849 | G | T | 198 | Val > Phe |
| 1215 | C | A | 320 | Pro > Thr |
| 1276 | G | A | 340 | Arg > Lys |

NOV1 SNP Data:

NOV1 has 19 SNP variants, whose variant positions for its nucleotide and amino acid sequences is numbered according to SEQ ID NOs: 25 and 26, respectively. The nucleotide sequence of the NOV1 variant differs as shown in Table 48.

TABLE 48 cSNP and Coding Variants for NOV1

| NT Position of cSNP | Wild Type NT | Variant NT | Amino Acid position | Amino Acid Change |
|---|---|---|---|---|
| 160 | T | C | 15 | Leu > Pro |
| 280 | A | G | 55 | Tyr > Cys |
| 904 | A | G | 263 | Glu > Gly |
| 997 | T | C | 294 | Ile > Thr |
| 1023 | T | C | 303 | Cys > Arg |
| 1041 | G | A | 309 | Glu > Lys |
| 1050 | G | A | 312 | Ala > Thr |
| 1051 | C | T | 312 | Ala > Val |
| 1054 | A | G | 313 | Glu > Gly |
| 1129 | T | A | 338 | Leu > Gln |
| 1207 | T | C | 364 | Leu > Pro |
| 1386 | G | A | 424 | Gly > Ser |
| 1636 | A | G | 507 | Gln > Arg |
| 1648 | T | C | 511 | Val > Ala |
| 1657 | A | G | 514 | Glu > Gly |
| 1680 | G | A | 522 | Ala > Thr |
| 1690 | A | T | 525 | Gln > Leu |
| 1779 | A | G | 555 | Ile > Val |
| 1902 | G | A | 596 | Ala > Thr |

NOV2 SNP Data:

NOV2 has four SNP variants, whose variant positions for its nucleotide and amino acid sequences is numbered according to SEQ ID NOs:27 and 28, respectively. The nucleotide sequence of the NOV2 variant differs as shown in Table 49.

TABLE 49 cSNP and Coding Variants for NOV2

| NT Position of cSNP | Wild Type NT | Variant NT | Amino Acid position | Amino Acid Change |
|---|---|---|---|---|
| 590 | A | G | 152 | Glu > Gly |
| 1350 | C | A | Silent | Silent |
| 3252 | G | A | Silent | Silent |
| 3721 | A | G | 1196 | Ile > Val |

NOV3 SNP Data:

NOV3 has six SNP variants, whose variant position for its nucleotide and amino acid sequences is numbered according to SEQ ID NOs:29 and 30, respectively. The nucleotide sequence of the NOV3 variant differs as shown in Table 50.

TABLE 50 cSNP and Coding Variants for NOV6

| NT Position of cSNP | Wild Type NT | Variant NT | Amino Acid position | Amino Acid Change |
|---|---|---|---|---|
| 437 | A | G | 143 | Asn > Ser |
| 664 | T | G | 219 | Phe > Val |
| 1150 | G | T | 381 | Ala > Ser |
| 1210 | G | T | 401 | Glu > Stop |
| 1770 | C | T | Silent | Silent |
| 2011 | A | G | Silent | Silent |

NOV4 SNP Data:

NOV4 has one SNP variant, whose variant position for its nucleotide and amino acid sequences is numbered according to SEQ ID NOs:31 and 32, respectively. The nucleotide sequence of the NOV4 variant differs as shown in Table 51.

TABLE 51 cSNP and Coding Variants for NOV4

| NT Position of cSNP | Wild Type NT | Variant NT | Amino Acid position | Amino Acid Change |
|---|---|---|---|---|
| 1038 | A | G | Silent | silent |

NOV5 SNP Data:

NOV5 has eleven SNP variants, whose variant position for its nucleotide and amino acid sequences is numbered according to SEQ ID NOs:33 and 34, respectively. The nucleotide sequence of the NOV5 variant differs as shown in Table 52.

TABLE 52 cSNP and Coding Variants for NOV5

| NT Position of cSNP | Wild Type NT | Variant NT | Amino Acid position | Amino Acid Change |
|---|---|---|---|---|
| 77 | T | A | Silent | Silent |
| 86 | T | C | Silent | Silent |
| 242 | C | T | Silent | Silent |
| 367 | C | T | 110 | Thr > Ile |
| 421 | T | C | 128 | Met > Thr |
| 1301 | C | T | Silent | Silent |
| 1459 | T | C | 474 | Leu > Pro |
| 1475 | C | T | Silent | Silent |
| 1497 | A | T | 487 | Thr > Ser |
| 1526 | T | C | Silent | Silent |
| 1634 | A | G | Silent | Silent |

NOV6 SNP Data:

NOV6 has two SNP variants, whose variant position for its nucleotide and amino acid sequences is numbered according to SEQ ID NOs:35 and 36, respectively. The nucleotide sequence of the NOV6 variants differs as shown in Table 53.

TABLE 53 cSNP and Coding Variants for NOV6

| NT Position of cSNP | Wild Type NT | Variant NT | Amino Acid position | Amino Acid Change |
|---|---|---|---|---|
| 1350 | A | G | 442 | Glu > Gly |
| 1602 | T | C | 526 | Val > Ala |

Example 4
In-Frame Cloning

NOV2 (CG56149-01)

The cDNA coding for the domain of CG56149-01 from residue 279 to 405 was targeted for "in-frame" cloning by PCR. The PCR template is based on human cDNA(s).

The following oligonucleotide primers were used to clone the target cDNA sequence:

```
F2  5'-GGATCC TCTGCAGCGGCTCTTTGTGTTGGAGTTGG-3'    (SEQ ID NO 298)

R2  5'-CTCGAG GCCAGGTCTAGCAAGCCTTCCAAACAACATTTCC-3'  (SEQ ID NO.225)
```

For downstream cloning purposes, the forward primer includes an in-frame BamH I restriction site and the reverse primer contains an in-frame Xho I restriction site.

Two parallel PCR reactions were set up using a total of 0.5–1.0 ng human pooled cDNAs as template for each reaction. The pool is composed of 5 micrograms of each of the following human tissue cDNAs: adrenal gland, whole brain, amygdala, cerebellum, thalamus, bone marrow, fetal brain, fetal kidney, fetal liver, fetal lung, heart, kidney, liver, lymphoma, Burkitt's Raji cell line, mammary gland, pancreas, pituitary gland, placenta, prostate, salivary gland, skeletal muscle, small Intestine, spleen, stomach, thyroid, trachea, uterus.

When the tissue of expression is known and available, the second PCR was performed using the above primers and 0.5 ng–1.0 ng of one of the following human tissue cDNAs:

skeleton muscle, testis, mammary gland, adrenal gland, ovary, colon, normal cerebellum, normal adipose, normal skin, bone marrow, brain amygdala, brain hippocampus, brain substantia nigra, brain thalamus, thyroid, fetal lung, fetal liver, fetal brain, kidney, heart, spleen, uterus, pituitary gland, lymph node, salivary gland, small intestine, prostate, placenta, spinal cord, peripheral blood, trachea, stomach, pancreas, hypothalamus.

The reaction mixtures contained 2 microliters of each of the primers (original concentration: 5 ppmol/ul), 1 microliter of 10 mM dNTP (Clontech Laboratories, Palo Alto Calif.) and 1 microliter of 50× Advantage-HF 2 polymerase (Clontech Laboratories) in 50 microliter-reaction volume. The following reaction conditions were used:

PCR condition 1:

a) 96° C.   3 minutes
b) 96° C.   30 seconds denaturation
c) 60° C.   30 seconds, primer annealing
d) 72° C.   6 minutes extension
            Repeat steps b-d 15 times e) 96° C.   15 seconds denaturation
f) 60° C.   30 seconds, primer annealing
g) 72° C.   6 minutes extension
            Repeat steps e-g 29 times e) 72° C.   10 minutes final extension PCR condition 2:

a) 96° C.   3 minutes
b) 96° C.   15 seconds denaturation
c) 76° C.   30 seconds, primer annealing, reducing the temperature by 1° C. per cycle
d) 72° C.   4 minutes extension
            Repeat steps b-d 34 times e) 72° C.   10 minutes final extension An amplified product was detected by agarose gel electrophoresis. The fragment was gel-purified and ligated into the pCR2.1 vector (Invitrogen, Carlsbad, Calif.) following the manufacturer's recommendation. Twelve clones per PCR reaction were picked and sequenced. The inserts were sequenced using vector-specific M13 Forward and M13 Reverse primers.

The insert assembly 164187747 was found to encode an open reading frame between residues 279 and 405 of the target sequence of CG56149-01. The cloned insert is 100% identical to the original amino acid sequence. The alignment with CG56149-01 is displayed in a CLUSTAL W (1.7) multiple sequence alignment below. Note that differing amino acids have a white or grey background, and deleted/inserted amino acids can be detected by a dashed line in the sequence that does not code at that position.

The cDNA coding for the FULL LENGTH of CG56149-04 from residue a to B was targeted for "in-frame" cloning by PCR. The PCR template is based on the previously identified plasmid.

The following oligonucleotide primers were used to clone the target cDNA sequence:

| Primers | Sequences | |
|---|---|---|
| F1 | 5'-GCGGCCGCCCACC ATGCTGAGGAGAGTCACTGTTGCT-3' | (SEQ ID NO:226) |
| R1 | 5'-CTCGAG TTATTTGACTATTTTATGGTAGGGGAGAAGG-3' | (SEQ ID NO:227) |

For downstream cloning purposes, the forward primer includes an in-frame Not I restriction site and the reverse primer contains an in-frame Xho I restriction site.

Two PCR reactions were set up using a total of 1–5 ng of the plasmid that contains the insert for CG56149-04.

The reaction mixtures contained 2 microliters of each of the primers (original concentration: 5 pmol/ul), 1 microliter of 10 mM dNTP (Clontech Laboratories, Palo Alto Calif.) and 1 microliter of 50× Advantage-HF 2 polymerase (Clontech Laboratories) in 50 microliter-reaction volume. The following reaction conditions were used:

PCR condition 1:

a) 96° C.   3 minutes
b) 96° C.   30 seconds denaturation
c) 60° C.   30 seconds, primer annealing
d) 72° C.   6 minutes extension
            Repeat steps b-d 15 times e) 96° C.   15 seconds denaturation
f) 60° C.   30 seconds, primer annealing
g) 72° C.   6 minutes extension
            Repeat steps e-g 29 times e) 72° C.   10 minutes final extension PCR condition 2:

a) 96° C.   3 minutes
b) 96° C.   15 seconds denaturation
c) 76° C.   30 seconds, primer annealing reducing the temperature by 1° C. per cycle
d) 72° C.   4 minutes extension
            Repeat steps b-d 34 times e) 72° C.   10 minutes final extension.

An amplified product was detected by agarose gel electrophoresis. The fragment was gel-purified and ligated into the pCR2.1 vector (Invitrogen, Carlsbad, Calif.) following the manufacturer's recommendation or digested with Not I and Xho I and ligated to pFastBac1. Twelve clones per PCR reaction were picked and sequenced. The inserts were sequenced using vector-specific M13 Forward and M13 Reverse primers and the following gene-specific primers:

| Primers | Sequences |
|---|---|
| SF1 SEQ ID NO:228 | TCAATCTTCTCCTCAAAGCTAGAAAGA |
| SF2 SEQ ID NO:229 | CAGAGGCTTGAAGTTTAGTTTGTCAAC |
| SF3 SEQ ID NO:230 | GTTTGTGGTTAAATCCTTTCACTCGAATA |
| SF4 SEQ ID NO:231 | TTTCAGCTGGAAGATGAAGATCTGG |
| SF5 SEQ ID NO:232 | TCCTCAATTTTCCGAATCTCTTCAA |
| SF6 SEQ ID NO:233 | TGTTAAATGCTGGTGTGTCAAATGG |
| SF7 SEQ ID NO:234 | CTTCAACTTCACGGTCAATTGCATCT |

-continued

| Primers | Sequences |
|---|---|
| SF8 SEQ ID NO:235 | TGCTCTCTCTTCTAATTCTTCCAATTCA |
| SF9 SEQ ID NO:236 | CAGGTAGACTTCGCCTTGTTCCTTC |
| SR1 SEQ ID NO:237 | CTAGCTTTGAGGAGAAGATTGAGAACC |
| SR2 SEQ ID NO:238 | CTAAACTTCAAGCCTCTGGAGCAGGAG |
| SR3 SEQ ID NO:239 | CCACAAACTACCTCTACTGTTTCAGCTC |

-continued

| Primers | | Sequences |
|---|---|---|
| SR4 | SEQ ID NO:240 | CATCTTCCAGCTGAAAACAAGTACATAGC |
| SR5 | SEQ ID NO:241 | AATTTTTGAAGAGATTCGGAAAATTGA |
| SR6 | SEQ ID NO:242 | TGACACACCAGCATTTAACAAACTTTA |
| SR7 | SEQ ID NO:243 | GTGAATATCAACTTGCAAGGCCTTCTG |
| SR8 | SEQ ID NO:244 | GGAAGAATTAGAAGAGAGAGCAGAAGC |
| SR9 | SEQ ID NO:24 | GAAGGAACAAGGCGAAGTCTACCTG |

The insert assembly 171093681 was found to encode an open reading frame between residues 1 and 1151 of the target sequence of CG56149-04. The cloned insert is 100% identical to the original sequence. The alignment with CG56149-04 is displayed in a CLUSTAL W (1.7) multiple sequence alignment below. Note that differing amino acids have a white or grey background, and deleted/inserted amino acids can be detected by a dashed line in the sequence that does not code at that position.

NOV3 (CG56155)

The cDNA coding for the mature form of CG56155-02 from residue 20 to 638 was targeted for "in-frame" cloning by PCR. The PCR template is based on the previously identified plasmid, when available, or on human cDNA(s).

The following oligonucleotide primers were used to clone the target cDNA sequence:

| Primers | Sequences |
|---|---|
| | (SEQ ID NO:246) |
| F1 | 5' GGATCC GGATGTCTGACTCAACTCTATGAAAACG 3' |
| | (SEQ ID NO:247) |
| R1 | 5'-CTCGAG TGCTGGTGACTGCATCTGAGCTTTTCC 3' |

For downstream cloning purposes, the forward primer includes an in-frame BamH I restriction site and the reverse primer contains an in-frame Xho I restriction site.

Two PCR reactions were set up using a total of 1–5 ng of the plasmid that contains the insert for CG56155-02.

The reaction mixtures contained 2 microliters of each of the primers (original concentration: 5 pmol/ul), 1 microliter of 10 mM dNTP (Clontech Laboratories, Palo Alto Calif.) and 1 microliter of 50× Advantage-HF 2 polymerase (Clontech Laboratories) in 50 microliter-reaction volume. The following reaction conditions were used:

PCR condition 1:

| a) | 96° C. | 3 minutes |
|---|---|---|
| b) | 96° C. | 30 seconds denaturation |
| c) | 60° C. | 30 seconds, primer annealing |
| d) | 72° C. | 6 minutes extension |
| | | Repeat steps b-d 15 times |
| e) | 96° C. | 15 seconds denaturation |
| f) | 60° C. | 30 seconds, primer annealing |
| g) | 72° C. | 6 minutes extension |
| | | Repeat steps e-g 29 times |
| e) | 72° C. | 10 minutes final extension |

PCR condition 2:

| a) | 96° C. | 3 minutes |
|---|---|---|
| b) | 96° C. | 15 seconds denaturation |
| c) | 76° C. | 30 seconds, primer annealing, reducing the temperature by 1° C. per cycle |
| d) | 72° C. | 4 minutes extension |
| | | Repeat steps b-d 34 times |
| e) | 72° C. | 10 minutes final extension |

An amplified product was detected by agarose gel electrophoresis. The fragment was gel-purified and ligated into the pCR2.1 vector (Invitrogen, Carlsbad, Calif.) following the Manufacturer's recommendation. Twelve clones per PCR reaction were picked and sequenced. The inserts were sequenced using vector-specific M13 Forward and M13 Reverse primers and the following gene-specific primers:

| Primers | | Sequences |
|---|---|---|
| SF1 | SEQ ID NO:248 | TTTTCTGGCATTCTTCATTTGTTACC |
| SF2 | SEQ ID NO:249 | ACTATAGATGCGCCAAACATCCTGC |
| SF3 | SEQ ID NO:250 | TCCTTACAGTCTTCTGGGAGTAAAGAA |
| SF4 | SEQ ID NO:251 | AGAAGAGGCAGTTGGGGTGATAGGT |
| SF5 | SEQ ID NO:252 | TTCAACACTGCTAACCTTAGACACATT |
| SR1 | SEQ ID NO:253 | GAAGAATGCCAGAAAAGATATCAAGATT |
| SR2 | SEQ ID NO:254 | TTGGCGCATCTATAGTGGCATTTT |
| SR3 | SEQ ID NO:255 | CAGAAGACTGTAAGGAAGAGAAGTGTAA |
| SR4 | SEQ ID NO:256 | CCCAACTGCCTCTTCTTTACATTCTATAC |
| SR5 | SEQ ID NO:257 | AAAAAGGTGCACCAGTAACATTCGC |

The insert assembly 172884585 was found to encode an open reading frame between residues 20 and 638 of the target sequence of CG56155-02. The cloned insert is 100% identical to the original amino acid sequence. The alignment with CG56155-02 is displayed in a CLUSTAL W (1.7) multiple sequence alignment below. Note that differing amino acids have a white or grey background, and deleted/inserted amino acids can be detected by a dashed line in the sequence that does not code at that position.

NOV5 (CG56151)

The cDNA coding for the domain of CG56151-02 from residue 13 to 499 was targeted for "in-frame" cloning by PCR. The PCR template is based on the previously identified plasmid, when available, or on human cDNA(s).

The following oligonucleotide primers were used to clone the target cDNA sequence:

(SEQ ID NO:258)
F3: 5'-GGATCC ACTGTCATCACTGCTGTGCTGGGTTCCTTCC-3'

(SEQ ID NO:259)
R2: 5'-CTCGAG GAATTCTGCAGCAATTTCCTCAAAAGACTTTCC-3'

For downstream cloning purposes, the forward primer includes an in-frame Bam HI restriction site and the reverse primer contains an in-frame Xho I restriction site.

FCA as Template:

Two PCR reactions were set up using a total of 1–5 ng of the plasmid that contains the insert for CG56151-02.

When the tissue of expression is known and available, the second PCR was performed using the above primers and 0.5 ng–1.0 ng of one of the following human tissue cDNAs: skeleton muscle, testis, mammary gland, adrenal gland, ovary, colon, normal cerebellum, normal adipose, normal skin, bone marrow, brain amygdala, brain hippocampus, brain substantia nigra, brain thalamus, thyroid, fetal lung, fetal liver, fetal brain, kidney, heart, spleen, uterus, pituitary gland, lymph node, salivary gland, small intestine, prostate, placenta, spinal cord, peripheral blood, trachea, stomach, pancreas, hypothalamus.

The reaction mixtures contained 2 microliters of each of the primers (original concentration: 5 pmol/ul), 1 microliter of 10 mM dNTP (Clontech Laboratories, Palo Alto Calif.) and 1 microliter of 50× Advantage-HF 2 polymerase (Clontech Laboratories) in 50 microliter-reaction volume. The following reaction conditions were used:

PCR condition 1:

a) 96° C.   3 minutes
b) 96° C.   30 seconds denaturation
c) 60° C.   30 seconds, primer annealing
d) 72° C.   6 minutes extension
            Repeat steps b-d 15 times e) 96° C.   15 seconds denaturation
f) 60° C.   30 seconds, primer annealing
g) 72° C.   6 minutes extension
            Repeat steps e-g 29 times e) 72° C.   10 minutes final extension PCR condition 2:

a) 96° C.   3 minutes
b) 96° C.   15 seconds denaturation
c) 76° C.   30 seconds, primer annealing, reducing the temperature by 1° C. per cycle
d) 72° C.   4 minutes extension
            Repeat steps b-d 34 times e) 72° C.   10 minutes final extension An amplified product was detected by agarose gel electrophoresis. The fragment was gel-purified and ligated into the pCR2.1 vector (Invitrogen, Carlsbad, Calif.) following the manufacturer's recommendation. Twelve clones per PCR reaction were picked and sequenced. The inserts were sequenced using vector-specific M13 Forward and M13 Reverse primers and the following gene-specific primers:

SF1:  CCCTGTCTGTATCCAGCTTTGCAGTT   (SEQ ID NO:260)
SF2:  TATATCGGTGAAATTGCTCCAACCG    (SEQ ID NO:261)
SF3:  TGAAAAGACTCAGAGGATATGATGATG  (SEQ ID NO:262)
SF4:  TTTATGCAACCATTGGAGTTGGC      (SEQ ID NO:263)
SF5:  ATCTTCCTCTTTGTCAGCTTCTTTGAA  (SEQ ID NO:264)
SR1:  ACCAGAGCATGGTGATTAGTTGAGC    (SEQ ID NO:265)
SR2:  ATTTCACCGATATACATAGGAACCAGG  (SEQ ID NO:266)
SR3:  AGCTTTGTTTTGCTTTGACTTCCTC    (SEQ ID NO:267)
SR4:  ATAAACAGGTTTGCTGATACCAGCCGT  (SEQ ID NO:268)
SR5:  TGGCTATCATGCTCACATAACTCATC   (SEQ ID NO:269)

Results:

The insert assembly 235651305 was found to encode an open reading frame between residues 13 and 499 of the target sequence of CG56151-02. The cloned insert is 100% identical to the original sequence. The alignment with CG56151-02 is displayed in a ClustalW below. Note that differing amino acids have a white or grey background, and deleted/inserted amino acids can be detected by a dashed line in the sequence that does not code at that position.

NOV7 (CG55117)

The cDNA coding for the mature form of CG55117-04 from residue 20 to 865 was targeted for "in-frame" cloning by PCR. The PCR template is based on human cDNA(s).

The following oligonucleotide primers were used to clone the target cDNA sequence:

(SEQ ID NO:270)
F1 5'-GGATCC GGAGGGCAGCCTTCATCCACAGATGCTCCTAAGG-3'

(SEQ ID NO:271)
R1 5'-CTCGAG ATGTTGTGATGGGCTTGTCATAACAGG-3'

For downstream cloning purposes, the forward primer includes an in-frame BamHI restriction site and the reverse primer contains an in-frame XhoI restriction site.

Two parallel PCR reactions were set up using a total of 0.5–1.0 ng human pooled cDNAs as template for each reaction. The pool is composed of 5 micrograms of each of the following human tissue cDNAs: adrenal gland, whole brain, amygdala, cerebellum, thalamus, bone marrow, fetal brain, fetal kidney, fetal liver, fetal lung, heart, kidney, liver, lymphoma, Burkitt's Raji cell line, mammary gland, pancreas, pituitary gland, placenta, prostate, salivary gland, skeletal muscle, small Intestine, spleen, stomach, thyroid, trachea, uterus.

When the tissue of expression is known and available, the second PCR was performed using the above primers and 0.5 ng–1.0 ng of one of the following human tissue cDNAs:

skeleton muscle, testis, mammary gland, adrenal gland, ovary, colon, normal cerebellum, normal adipose, normal skin, bone marrow, brain amygdala, brain hippocampus, brain substantia nigra, brain thalamus, thyroid, fetal lung, fetal liver, fetal brain, kidney, heart, spleen, uterus, pituitary gland, lymph node, salivary gland, small intestine, prostate, placenta, spinal cord, peripheral blood, trachea, stomach, pancreas, hypothalamus.

The reaction mixtures contained 2 microliters of each of the primers (original concentration: 5 pmol/ul), 1 microliter of 10 mM dNTP (Clontech Laboratories, Palo Alto Calif.) and 1 microliter of 50× Advantage-HF 2 polymerase (Clontech Laboratories) in 50 microliter-reaction volume. The following reaction conditions were used:

PCR condition 1:

a) 96° C.   3 minutes
b) 96° C.   30 seconds denaturation
c) 60° C.   30 seconds, primer annealing
d) 72° C.   6 minutes extension
            Repeat steps b-d 15 times e) 96° C.   15 seconds denaturation
f) 60° C.   30 seconds, primer annealing
g) 72° C.   6 minutes extension
            Repeat steps e-g 29 times e) 72° C.   10 minutes final extension PCR condition 2:

a) 96° C.   3 minutes
b) 96° C.   15 seconds denaturation
c) 76° C.   30 seconds, primer annealing, reducing the temperature by 1° C. per cycle
d) 72° C.   4 minutes extension
            Repeat steps b-d 34 times e) 72° C.   10 minutes final extension An amplified product was detected by agarose gel electrophoresis. The fragment was gel-purified and ligated into the pCR2.1 vector (Invitrogen, Carlsbad, Calif.) following the manufacturer's recommendation. Twelve clones per PCR reaction were picked and sequenced. The inserts were sequenced using vector-specific M13 Forward and M13 Reverse primers and the following gene-specific primers:

| | | |
|---|---|---|
| SF1: | TTTTGTATGTGTCGTTGCTGTAACAAA | (SEQ ID NO:272) |
| SF2: | ATTCAGTGCTAGGAGGCGGAATTCTT | (SEQ ID NO:273) |
| SF3: | TGGATGCAGAACTTGACAACGTTAATA | (SEQ ID NO:274) |
| SF4: | TTTTTACTACCTGGGCTTACTGTGTGGC | (SEQ ID NO:275) |
| SF5: | TGAAGCTCACTTTTGAACAAGTTTACAG | (SEQ ID NO:276) |
| SF6: | CATATGATCTAGAAGCAAAAGCAAACA | (SEQ ID NO:277) |
| SF7: | GCCACCGCTCTAGATACTGCTGTT | (SEQ ID NO:278) |
| SR1: | AAATACCCCACCAGAGGCATCAGAATA | (SEQ ID NO:279) |
| SR2: | TTGATACTGTTCAGATCTGTGAACGCC | (SEQ ID NO:280) |
| SR3: | AACGTTGTCAAGTTCTGCATCCAC | (SEQ ID NO:281) |
| SR4: | CCACACAGTAAGCCCAGGTAGTAAAA | (SEQ ID NO:282) |
| SR5: | AATAGCTTCCCAGAGAGATAGTATTCCCA | (SEQ ID NO:283) |
| SR6: | AACTGTTTGCTTTTGCTTCTAGATCAT | (SEQ ID NO:284) |
| SR7: | CACGATGCCACTTTCTCACTGATAG | (SEQ ID NO:285) |

The insert assembly 188822829 was found to encode an open reading frame between residues 20 and 865 of the target sequence CG55117-04. 188822829 differs from the original sequence at 2 nucleotide positions and 2 amino acid positions. It also has a 27 nuclotide/9 amino acid deletion as compared to the original sequence. The alignment with CG55117-04 is displayed in a ClustalW below. Note that differing amino acids have a white or grey background, and deleted/inserted amino acids can be detected by a dashed line in the sequence that does not code at that position.

NOV8 (CG56006-01)

The cDNA coding for the domain of CG56006-01 from residue 44 to 417 was targeted for "in-frame" cloning by PCR. The PCR template is based on the previously identified plasmid, when available, or on human cDNA(s).

The following oligonucleotide primers were used to clone the target cDNA sequence:

(SEQ ID NO:286)
F1: 5'-AAGCTT AGGAGTGACCAGGAGCCGCTGTACCCAGTGC-3'

(SEQ ID NO:287)
R1: 5'-GTCGAC GAGCTGGGTCACCATGCCGCTGGCTTCGG-3'

For downstream cloning purposes, the forward primer includes an in-frame Hind III restriction site and the reverse primer contains an in-frame Sal I restriction site.

FIS as Template:

Two parallel PCR reactions were set up using a total of 0.5–1.0 ng human pooled cDNAs as template for each reaction. The pool is composed of 5 micrograms of each of the following human tissue cDNAs: adrenal gland, whole brain, amygdala, cerebellum, thalamus, bone marrow, fetal brain, fetal kidney, fetal liver, fetal lung, heart, kidney, liver, lymphoma, Burkitt's Raji cell line, mammary gland, pancreas, pituitary gland, placenta, prostate, salivary gland, skeletal muscle, small Intestine, spleen, stomach, thyroid, trachea, uterus.

When the tissue of expression is known and available, the second PCR was performed using the above primers and 0.5 ng–1.0 ng of one of the following human tissue cDNAs: skeleton muscle, testis, mammary gland, adrenal gland, ovary, colon, normal cerebellum, normal adipose, normal skin, bone marrow, brain amygdala, brain hippocampus, brain substantia nigra, brain thalamus, thyroid, fetal lung, fetal liver, fetal brain, kidney, heart, spleen, uterus, pituitary gland, lymph node, salivary gland, small intestine, prostate, placenta, spinal cord, peripheral blood, trachea, stomach, pancreas, hypothalamus.

The reaction mixtures contained 2 microliters of each of the primers (original concentration: 5 pmol/ul), 1 microliter of 10 mM dNTP (Clontech Laboratories, Palo Alto Calif.) and 1 microliter of 50× Advantage-HF 2 polymerase (Clontech Laboratories) in 50 microliter-reaction volume. The following reaction conditions were used:

PCR condition 1:

| | | |
|---|---|---|
| a) | 96° C. | 3 minutes |
| b) | 96° C. | 30 seconds denaturation |
| c) | 60° C. | 30 seconds, primer annealing |
| d) | 72° C. | 6 minutes extension |
| | | Repeat steps b-d 15 times |
| e) | 96° C. | 15 seconds denaturation |
| f) | 60° C. | 30 seconds, primer annealing |
| g) | 72° C. | 6 minutes extension |
| | | Repeat steps e-g 29 times |
| e) | 72° C. | 10 minutes final extension |

PCR condition 2:

| | | |
|---|---|---|
| a) | 96° C. | 3 minutes |
| b) | 96° C. | 15 seconds denaturation |
| c) | 76° C. | 30 seconds, reducing the temperature by 1° C. per cycle |
| d) | 72° C. | 4 minutes extension |
| | | Repeat steps b-d 34 times |
| e) | 72° C. | 10 minutes final extension. |

An amplified product was detected by agarose gel electrophoresis. The fragment was gel-purified, digested with Hind III and Sal I and ligated into the Hind III and Xho I sites of the GPIV5His vector (CuraGen, New Haven, Conn.). Twelve clones per PCR reaction were picked and sequenced. The inserts were sequenced using vector-specific M13 Forward and M13 Reverse primers and the following gene-specific primers:

| | | |
|---|---|---|
| SF1: | AGCCTCCCCTCGTCCACACAGAAGAAG | (SEQ ID NO:288) |
| SF2: | CAAAGACCATGAGCCGAGCGT | (SEQ ID NO:289) |
| SF3: | TCTGCGCCATGTCACTGCCTCTTGTTA | (SEQ ID NO:290) |
| SF4: | GTGATCACGGACGCAGATTGG | (SEQ ID NO:291) |
| SF5: | CTGGATTTGCAGGGATGGGG | (SEQ ID NO:292) |
| SR1: | CAGAGGCTGCTGGAGGTCATC | (SEQ ID NO:293) |
| SR2: | GACAAGACGGAAGGGACGTGG | (SEQ ID NO:294) |
| SR3: | GAAGGAGGGTGGCCGGACT | (SEQ ID NO:295) |
| SR4: | CTCTGGCCAAGGCCCAGTC | (SEQ ID NO:296) |
| SR5: | CCCGCTGCTGGTCAGACAC | (SEQ ID NO:297) |

Results:

The insert assemblies 235653236, 235653319, 235653473, 235653548, 235653650, 235653703, 235653707 and 235653711 were found to encode an open reading frame between residues 44 and 417 of the target sequence of CG56006-01. The cloned inserts are 100% identical to the original DNA sequence. The alignment of the amino acid sequences with CG56006-01 is displayed in a ClustalW below. The first 33 amino acids of the ORFs from assemblies 235653236, 235653319, 235653473, 235653548, 235653650, 235653703, 235653707 and 235653711 are the signal peptide encoded by the GPIV5 vector. The cloned insert begins with the amino acids LR at positions 44 and 45 and ends with the amino acids QL at positions 416 and 417 of the CG56006-01 peptide. The GPIV5 vector encodes the amino acids from position 408 to the end of the assembly sequence. Note that differing amino acids have a white or gray background while dashed lines indicate deleted or inserted amino acids in the sequence.

SEC9

The cDNA coding for the domain/full length of CG56162-02 from residue 1 to 283 was targeted for "in-frame" cloning by PCR. The PCR template is based on the previously identified plasmid.

The following oligonucleotide primers were used to clone the target cDNA sequence:

| Primers | Sequences |
|---|---|
| F1 (SEQ ID NO:307) | 5'-AGATCT ATGGAAACAGGACCTGAAGACC CTTCCAGC-3' |
| R1 (SEQ ID NO:308) | 5'-CTCGAG GGGTGGGGACGCAGTTCCTGCC GTGGC-3' |

For downstream cloning purposes, the forward primer includes an in-frame Bgl II restriction site and the reverse primer contains an in-frame Xho I restriction site.

Two PCR reactions were set up using a total of 1–5 ng of the plasmid that contains the insert for CG56162-02.

The reaction mixtures contained 2 microliters of each of the primers (original concentration: 5 pmol/ul), 1 microliter of 10 mM dNTP (Clontech laboratories, Palo Alto Calif.) and 1 microliter of 50× Advantage-HF 2 polymerase (Clontech Laboratories) in 50 microliter-reaction volume. The following reaction conditions were used:

PCR condition 1:

a) 96° C. 3 minutes
b) 96° C. 30 seconds denaturation
c) 60° C. 30 seconds, primer annealing
d) 72° C. 6 minutes extension
  Repeat steps b-d 15 times e) 96° C. 15 seconds denaturation
f) 60° C. 30 seconds, primer annealing
g) 72° C. 6 minutes extension
  Repeat steps e-g 29 times e) 72° C. 10 minutes final extension PCR condition 2:

a) 96° C. 3 minutes
b) 96° C. 15 seconds denaturation
c) 76° C. 30 seconds, primer annealing, reducing the temperature by 1° C. per cycle
d) 72° C. 4 minutes extension
  Repeat steps b-d 34 times e) 72° C. 10 minutes final extension An amplified product was detected by agarose gel electrophoresis. The fragment was gel-purified and ligated into the pCR2.1 vector (Invitrogen, Carlsbad, Calif.) following the manufacturer's recommendation. Twelve clones per PCR reaction were picked and sequenced. The inserts were sequenced using vector-specific M13 Forward and M13 Reverse primers and the following gene-specific primers:

| Primers | Sequences |
|---|---|
| SEQ ID NO.309 SF1 | GTAGTGTCTGACTTCCACGTTTTCG |
| SEQ ID NO.310 SF2 | GTGTGCTTCGGCATCCAACTG |
| SEQ ID NO.311 SR1 | ATCCTCTCCCCTTCGCTCTGT |
| SEQ ID NO.312 SR2 | AAGCACACCTTCAGCCCTGC |

The insert can be subsequently cloned into a chosen expression vector by digestion/ligation.

The insert assembly 174228465 (SEQ ID NO: 321) was found to encode an open reading frame between residues 1 and 283 of the target sequence of CG56162-02. The cloned insert differs from the original amino acid sequence at one position (H228). The alignment of the 174228465 polypeptide (SEQ ID NO: 322) with CG56162-02 is displayed in a CLUSTAL W (1.7) multiple sequence alignment below. Note that differing amino acids have a white or grey background, and deleted/inserted amino acids can be detected by a dashed line in the sequence that does not code at that position.

>174228465 (SEQ ID NO: 321)
AGATCTATGGAAACAGGACCTGAAGACCCTTCCAGCATGCCAGAGGAAAGTTCCCCCAGGCGGACCCCGC

AGAGCATTCCCTACCAGGACCTCCCTCACCTGGTCAATGCAGACGGACAGTACCTCTTCTGCAGGTACTG

GAAACCCACAGGCACACCCAAGGCCCTCATCTTTGTGTCCCATGGAGCCGGAGAGCACAGTGGCCGCTAT

GAAGAGCTGGCTCGGATGCTGATGGGGCTGGACCTGCTGGTGTTCGCCCACGACCATGTTGGCCACGGAC

AGAGCGAAGGGGAGAGGATGGTAGTGTCTGACTTCCACGTTTTCGTCAGGGATGTGTTGCAGCATGTGGA

TTCCATGCAGAAAGACTACCCTGGGCTTCCTGTCTTCCTTCTGGGCCACTCCATGGGAGGCGCCATCGCC

ATCCTCACGGCCGCAGAGAGGCCGGGCCACTTCGCCGGCATGGTACTCATTTCGCCTCTGGTTCTTGCCA

ATCCTGAATCTGCAACAACTTTCAAGGTCGACATTTATAACTCAGACCCCCTGATCTGCCGGGCAGGGCT

GAAGGTGTGCTTCGGCATCCAACTGCTGAATGCCGTCTCACGGGTGGAGCGCGCCCTCCCCAAGCTGACT

GTGCCCTTCCTGCTGCTCCAGGGCTCTGCCGATCGCCTATGTGACAGCAAAGGGGCCTACCTGCTCATGG

-continued
```
AGTTAGCCAAGAGCCAGGACAAGACTCTCAAGATTTATGAAGGTGCCTACCATGTTCTCCACAAGGAGCT

TCCTGAAGTCACCAACTCCGTCTTCCATGAAATAAACATGTGGGTCTCTCAAAGGACAGCCACGGCAGGA

ACTGCGTCCCCACCCCTCGAG
```

Multiple Alignment:

```
174228465    1 RSMETGPEDPSSMPEESSPRRTPQSIPYQDLPHLVNADGQYLFCRYWKPTGTPKALIFVS  60
CG56162-02   1 --METGPEDPSSMPEESSPRRTPQSIPYQDLPHLVNADGQYLFCRYWKPTGTPKALIFVS  58

174228465   61 HGAGEHSGRYEELARMLMGLDLLVFAHDHVGHGQSEGERMVVSDFHVFVTDVLQHVDSMQ 120
CG56162-02  59 HGAGEHSGRYEELARMLMGLDLLVFAHDHVGHGQSEGERMVVSDFHVFVTDVLQHVDSMQ 118

174228465  121 KDYPGLPVFLLGHSMGGAIAILTAAERPGHFAGMVLISPLVLANPESATTFKVDIYNSDP 180
CG56162-02 119 KDYPGLPVFLLGHSMGGAIAILTAAERPGHFAGMVLISPLVLANPESATTFKVDIYNSDP 178

174228465  181 LICRAGLKVCFGIQLLNAVSRVERALPKLTVPFLLLQGSADRLCDSKGAYLLMELAKSQD 240
CG56162-02 179 LICRAGLKVCFGIQLLNAVSRVERALPKLTVPFLLLQGSADRLCDSKGAHLLMELAKSQD 238

174228465  241 KTLKIYEGAYHVLHKELPEVTNSVFHEINMWVSQRTATAGTASPPLE              287
CG56162-02 239 KTLKIYEGAYHVLHKELPEVTNSVFHEINMWVSQRTATAGTASPP--              283
```

NOV4

The cDNA coding for the domain/full length of NOV4b (CG56166-02) from residue 1 to 312 was targeted for "in-frame" cloning by PCR. The PCR template is based on the previously identified plasmid, when available, or on human cDNA(s). The following oligonucleotide primers were used to clone the target cDNA sequence:

```
F1                                    (SEQ ID NO:313)
5'-AGATCTCCCACC ATGGCTAACCGTACAGTGAAGGATGCG-3'

R1                                    (SEQ ID NO: 314)
5'-GTCGAC CTCATTCCCTCTCCGGCTCTTCTTGTG-3'
```

For downstream cloning purposes, the forward primer includes an in-frame Bgl II restriction site and the reverse primer contains an in-frame Sal I restriction site.

Two PCR reactions were set up using a total of 1–5 ng of the plasmid that contains the insert for CG56166-02.

The reaction mixtures contained 2 microliters of each of the primers (original concentration: 5 pmol/ul), 1 microliter of 10 mM dNTP (Clontech Laboratories, Palo Alto Calif.) and 1 microliter of 50× Advantage-HF 2 polymerase (Clontech laboratories) in 50 microliter-reaction volume. The following reaction conditions were used:

PCR condition 1:

| | | |
|---|---|---|
| a) | 96° C. | 3 minutes |
| b) | 96° C. | 30 seconds denaturation |
| c) | 60° C. | 30 seconds, primer annealing |
| d) | 72° C. | 6 minutes extension |
| | | Repeat steps b-d 15 times |
| e) | 96° C. | 15 seconds denaturation |
| f) | 60° C. | 30 seconds, primer annealing |
| g) | 72° C. | 6 minutes extension |
| | | Repeat steps e-g 29 times |
| e) | 72° C. | 10 minutes final extension |

PCR condition 2:

| | | |
|---|---|---|
| a) | 96° C. | 3 minutes |
| b) | 96° C. | 15 seconds denaturation |
| c) | 76° C. | 30 seconds, primer annealing, reducing the temperature by 1° C. per cycle |
| d) | 72° C. | 4 minutes extension |
| | | Repeat steps b-d 34 times |
| e) | 72° C. | 10 minutes final extension |

An amplified product was detected by agarose gel electrophoresis. The fragment was gel-purified and ligated into the pCR2.1 vector (Invitrogen, Carlsbad, Calif.) following the manufacturer's recommendation. Twelve clones per PCR reaction were picked and sequenced. The inserts were sequenced using vector-specific M13 Forward and M13 Reverse primers and the following gene-specific primers:

```
SF1
CTCCACATCATCCATGTCCTCTTC         (SEQ ID NO: 315)

SF2
CTTCTCGGGTTGAATTTGAAGCAT         (SEQ ID NO: 316)

SR1
GTCCAGTGAAGAGGAAGAAGAGGAG        (SEQ ID NO: 317)

SR2
CGAGAAGGATATCATTGTAGAGTTTATCAAAA (SEQ ID NO: 318)
```

The insert can be subsequently cloned into a chosen expression vector by digestion/ligation.

The insert assembly 174228537 (SEQ ID NO: 323) was found to encode an open reading frame between residues 1 and 312 of the target sequence of CG56166-02. The cloned insert differs from the original amino acid sequence at one position (1224). The alignment of 174228537 polypeptide (SEQ ID NO: 324) with CG56166-02 is displayed in a CLUSTAL W (1.7) multiple sequence alignment below. Note that differing amino acids have a white or grey background, and deleted/inserted amino acids can be detected by a dashed line in the sequence that does not code at that position.

>174228537                                                (SEQ ID NO: 323)
AGATCTCCCACCATGGCTAACCGTACAGTGAAGGATGCGCACAGCATCCATGGCACCAACCCTCAATATC

TGGTGGAGAAGATCATTCGAACGCGAATCTATGAGTCCAAGTACTGGAAAGAGGAGTGCTTTGGACTTAC

AGCTGAACTTGTAGTCGATAAAGCCATGGAGTTAAGGTTTGTGGGTGGCGTCTATGGTGGCAACATAAAA

CCAACACCCTTTCTGTGTTTAACCTTGAAGATGCTTCAAATTCAACCCGAGAAGGATATCATTGTAGAGT

TTATCAAAAATGAAGATTTCAAGTATGTCCGCATGCTGGGGGCACTTTACATGAGGCTGACAGGCACTGC

AATTGATTGCTACAAGTACTTGGAACCTTTGTACAATGACTATCGAAAAATCAAGAGCCAGAACCGAAAT

GGGGAGTTTGAATTGATGCATGTTGATGAGTTTATTGATGAACTATTGCACAGTGAGAGAGTCTGTGATA

TCATTCTGCCCCGACTACAGAAACGCTATGTATTAGAGGAAGCTGAGCAACTGGAGCCTCGAGTTAGTGC

TCTGGAAGAGGACATGGATGATGTGGAGTCCAGTGAAGAGGAAGAAGAGGAGGATGAGAAGTTGGAAAGA

GTGCCATCACCTGATCACCGCCGGAGAAGCTACCGAGACTTGGACAAGCCCCGTCCCTCTCCCACACYGC

GCTACAGGAGGAGTAGGAGCCGGTCTCCCAGAAGGCGGAGTCGATCTCCCAAAAGGAGAAGCCCCTCCCC

TCGCCGAGAAAGGCATCGGAGCAAGAGTCCAAGACGTCACCGCAGCAGGTCCCGAGATCGGCGGCACAGA

TCCCGTTCCAAGTCCCCAGGTCATCACCGTAGTCACAGACACAGGAGCCACTCAAAGTCTCCCGAAAGGT

CTAAGAAGAGCCACAAGAAGAGCCGGAGAGGGAATGAGGTCGAC

```
174228537    1 RSPTMANRTVKDAHSIHGTNPQYLVEKIIRTRIYESKYWKEECFGLTAELVVDKAMELRF  60
CG56166-02   1 ----MANRTVKDAHSIHGTNPQYLVEKIIRTRIYESKYWKEECFGLTAELVVDKAMELRF  56

174228537   61 VGGVYGGNIKPTPFLCLTLKMLQIQPEKDIIVEFIKNEDFKYVRMLGALYMRLTGTAIDC 120
CG56166-02  57 VGGVYGGNIKPTPFLCLTLKMLQIQPEKDIIVEFIKNEDFKYVRMLGALYMRLTGTAIDC 116

174228537  121 YKYLEPLYNDYRKIKSQNRNGEFELMHVDEFIDELLHSERVCDIILPRLQKRYVLEEAEQ 180
CG56166-02 117 YKYLEPLYNDYRKIKSQNRNGEFELMHVDEFIDELLHSERVCDIILPRLQKRYVLEEAEQ 176

174228537  181 LEPRVSALEEDMDDVESSEEEEEDEKLERVPSPDHRRRSYRDLDKPRRSPTLRYRRSRS 240
CG56166-02 177 LEPRVSALEEDMDDVESSEEEEEDEKLERVPSPDHRRRSYRDLDKELRSPTLRYRRSRS 236

174228537  241 RSPRRRSRSPKRRSPSPRRERHRSKSPRRHRSRSRDRRHRSRSKSPGHHRSHRHRSHSKS 300
CG56166-02 237 RSPRRRSRSPKRRSPSPRRERHRSKSPRRHRSRSRDRRHRSRSKSPGHHRSHRHRSHSKS 296

174228537  301 PERSKKSHKKSRRGNEVD                                           318
CG56166-02 297 PERSKKSHKKSRRGNE--                                           312
```

Other Embodiments

Although particular embodiments have been disclosed herein in detail, this has been done by way of example for purposes of illustration only, and is not intended to be limiting with respect to the scope of the appended claims, which follow. In particular, it is contemplated by the inventors that various substitutions, alterations, and modifications may be made to the invention without departing from the spirit and scope of the invention as defined by the claims. The choice of nucleic acid starting material, clone of interest, or library type is believed to be a matter of routine for a person of ordinary skill in the art with knowledge of the embodiments described herein. Other aspects, advantages, and modifications considered to be within the scope of the following claims.

SEQUENCE LISTING (324 sequences)

SEQ ID NO: 1 - DNA, 1887 bp, Homo sapiens
gcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggtaaggagctgggattcgatgcctccgaggtggagttgacgagaaacaatgaattgattgcagttggaaaaggcagctcactgaagcggatccctgtttttggaatggagcctcgcatccgatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacct

SEQ ID NO: 2 - protein, 381 aa, Homo sapiens
MSSRIARALALVVTLLHLTRLALSTCPAACHCPLEAPKCAPGVGLVRDGCGCCKVCAKQLNEDCSKTQPCDHTKGLECNFGASSTALKGICRAQSEGRPCEYNSRIYQNGESFQPNCKHQCTCIDGAVGCIPLCPQELSLPNLGCPNPRLVKVTGQCCEEWVCDEDSIKDPMEDQDGLLGKELGFDASEVELTRNNELIAVGKGSSLKRIPVFGMEPRIRYNPLQGQKCIVQTTSWSQCSKTCGTGISTRVTNDNPECRLVKETRICEVRPCGQPVYSSLKKGKKCSKTKKSPEPVRFTYAGCLSVKKYRPKYCGSCVDGRCCTPQLTRTVKMRFRCEDGETFSKNVMMIQSCKCNYNCPHANEAAFPFYRLFNDIHKFRD

SEQ ID NO: 3 - DNA, 2114 bp, Homo sapiens
aggaattccggtggccggccactcccgtctgctgtgacgcgcggacagagagctaccggtggacccacggtgcctccctccctgggatctacacagaccatggccttgcaacggctcgacccctgttggtcctgtggggaccgccctggcagcctcctgttcctgctcttcagcctcggatgggtgcatcccgcgaggaccctggctggagagacagggacggagtctgcccccctggggggagtcctgacaaccccccataacatttccagcctctcccctcgccaactccttggcttcccgtgtgcggaggtgtccggcctgagcacggagcgtgtccgggagctggctgtggccttggcacagaagaatgtcaagctctcaacagagcagctgcgctgtctggctcaccggctctctgagccccccgaggacctggacgccctcccattggacctgctgctattcctcaacccagatgcgttctcggggccccaggcctgcacccgtttcttctcccgcatcacgaaggccaatgtggacctgctcccgaggggggctcccgagcgacagcggctgctgcctgcggctctggcctgctggggtgtgcgggggtctctgctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacggccccccgtcgacatggtctgtctccacgatggacgctctgcggggcctgctgcccgtgctgggccagcccatcatccgcagcatcccgcagggcatcgtggccgcgtggcggcaacgctcctctcgggacccatcctggcggcagcctgaacggaccatcctccggccgcggttccggcgggaagtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcgacaaagggcacgaaatgagtcctcaggctcctcggcggcccctcccacaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctgggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcgtgcaagagaccctctcggggacgccctgcctcctaggacctggacctgttctcaccgtcctggcactgctcctagcctccaccctggcctgagggccccactcccttgctggccccagccctgctggggatccccgcctggccaggagcaggcacgggtgatccccgttccaccccaagagaactcgcgctcagtaaacgggaacatgccccctgcagac

SEQ ID NO: 4 - protein, 628 aa, Homo sapiens
MALQRLDPCWSCGDRPGSLLFLLFSLGWVHPARTLAGETGTESAPLGGVLTTPHNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVDKGHEMSPQAPRRPLPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSVQETLSGTPCLLGPGPVLTVLALLLASTLA

SEQ ID NO: 5 - DNA, 852 bp, Homo sapiens
cttcctagctcctctcctccagggccagactgagcccaggttgatttcaggcggacaccaatagactccacagcagctccaggagcccagacaccggcggccagaagcaaggctaggagctgctgcagccatgtcggccctcagcctcctcattctgggcctgctcacggcagtgccacctgccagctgtcagcaaggcctggggaaccttcagccctggatgcagggccttatcgcggtggccgtgttcctggtcctcgttgcaatcgcctttgcagtcaaccacttctggtgccaggaggagccggagcctgcacacatgatcctgaccgtcggaaacaaggcagatggagtcctggtgggaacagatggaaggtactcttcgatggcggccagtttcaggtccagtgagcatgagaatgcctatgagaatgtgcccgaggaggaaggcaaggtccgcagcaccccgatgtaaccttctctgtggctccaaccccaagactcccaggcacatgggatggatgtccagtgctaccacccaagccccctccttctttgtgtggaatctgcaatagtgggctgactccctccagccccatgccggccctacccgcccttgaagtatagccagccaaggttggagctcagaccgtgtctaggttggggctcggctgtggccctggggtctcctgctcagctcagaagagccttctggagaggacagtcagctgagcacctcccatcctgctcacacgtccttccccataactatggaaatggccctaatttctgtgaaataaagactttttgtatttctggggctgaggctcagcaacagcccctcaggcttcc

SEQ ID NO: 6 - protein, 114 aa, Homo sapiens
MSALSLLILGLLTAVPPASCQQGLGNLQPWMQGLIAVAVFLVLVAIAFAVNHFWCQEEPEPAHMILTVGNKADGVLVGTDGRYSSMAASFRSSEHENAYENVPEEEGKVRSTPM

SEQ ID NO: 7 - DNA, 527 bp, Homo sapiens
ccgtcagtctagaaggataagagaaagaaagttaagcaactacaggaaatggctttgggagttccaatatcagtctatcttttattcaacgcaatgacagcactgaccgaagaggcagccgtgactgtaacacctccaatcacagcccagcaaggtaactggacagttaacaaaacagaagctcacaacatagaaggacccatagccttgaagttctcacacctttgcctggaagatcataacagttactgcatcaacggtgcttgtgcattccaccatgagctagagaaagccatctgcaggtgttttactggttatactggagaaaggtgtgagcacttgactttaacttcatatgctgtggattcttatgaaaaatacattgcaattgggattggtgttggattactattaagtggttttcttgttattttttactgctatataagaaagaggtgtctaaaattgaaatcgccttacaatgtctgttctggagaaagacgaccactgtgaggcctttgtgaaga

SEQ ID NO: 8 - protein, 154 aa, Homo sapiens
MALGVPISVYLLFNAMTALTEEAAVTVTPPITAQQGNWTVNKTEAHNIEGPIALKFSHLCLEDHNSYCINGACAFHHELEKAICRCFTGYTGERCEHLTLTSYAVDSYEKYIAIGIGVGLLLSGFLVIFYCYIRKRCLKLKSPYNVCSGERRPL

SEQ ID NO: 9 - DNA, 1293 bp, Homo sapiens
aggtggcgggcgggtacttaaggcgcggccaccgggctggcagtgcgcccaacagcggactccgagaccagcggatctcggcaaaccctctttctcgaccacccacctaccattcttggaaccatggcggcagtggcggcggcctcggctgaactgctcatcatcggctggtacatcttccgcgtgctgctgcaggtgttcctggaatgctgcatttactgggtaggattcgcttttcgaaatcctccagggacacagcccattgcgagaagtgaggtgttcaggtactccctgcagaagctggcatacacggtgtcgcggaccgggcggcaggtgttgggggagcgcaggcagcgagcccccaactgaggccccagctcccagccctgggcggccgtatcatcaggtgctcctgtgcatctcggccagcacgggagccagtgccgcgcaggaatgtggggtcccctgtgttccctcgccagagcacttggcaaggtcagtgaggggccagtagacccccggagaagcagtaccgacaatgacgaagataccagatcccttcccaacccctttgcaccggtcccactaaggggcagggtcgagagaggaggggggatagggggagcagaccctgagatctgggcataggcaccgcattctgatctggacaaagtcgggacagcaccatcccagccccgaagcccgggccatgccagcaggccccaccatggaaatcaaaacaccgcaccagccagcagaatggacattctgacatcgccagccgacgccctgaatcttggtgcagcacccaccgcgtgcctgtgtggcgggactggagggcacagttgaggaaggagggtggttaagaaatacagtggggccctctcgctgtcccttgcccagggcacttgtattccagcctcgctgcatttgctctctcgattgcccctttcctcctacatgcctcccaagcccaccctactccaaaagtaatgtgtcacttgatttggaactattcaagcagtaaaagtaaatgaatcccacctttactaaaacactttctctgaaccccccttgcccctcactgatcttgcttttccctggtctcagcagttgtggtcaatattgtggtaatcgctaattgtactgattgtttaagtgtgcattagttgtctctccccagctagattgtaagctcctggaggacagggaccacctctacaaaaaataaaaaaagtacctcccctgtctcgcacagtgtcccaggaccctgcggtgcagtagaggcgcacc

SEQ ID NO: 10 - protein, 81 aa, Homo sapiens
MAAVAAASAELLIIGWYIFRVLLQVFLECCIYWVGFAFRNPPGTQPIARSEVFRYSLQKLAYTVSRTGRQVLGERRQRAPN

SEQ ID NO: 11 - DNA, 679 bp, Homo sapiens
  misc_feature (599): Where n is G or A or T or C
ggcggcgttcgtgtccgaggtcactagtttcccggtagttcagctgcacatgaatagaacagcaatgagagccagtcagaaggactttgaaaattcaataaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatgcgtgcacttaaagctgccagcaaggatgactcaatcatcactgttttaacaggaaatggtgactattacagtagtgggaatgatctgactaacttcactgatattccccctggtggagtanaggagaaagctaaaaataatgccgttttactgaagggaatttgtgggctgttttatagaatttcctaagcctctgattgc

SEQ ID NO: 12 - protein, 205 aa, Homo sapiens
  VARIANT (184): Where Xaa is any amino acid as defined in the specification
MNRTAMRASQKDFENSINQVKLLKKDPGNEVKLKLYALYKQATEGPCNMPKPGVFDLINKAKWDAWNALGSLPKEAARQNYVDLVSSLSPSLESSSQVEPGTDRKSTGFETLVVTSEDGITKIMFNRPKKKNAINTEMYHEIMRALKAASKDDSIITVLTGNGDYYSSGNDLTNFTDIPPGGVXEKAKNNAVLLKGICGLFYRIS

SEQ ID NO: 13 - DNA, 3046 bp, Homo sapiens
tggggctgctccgttctctgcctggcctgaggctccctgagccgcctccccaccatcaccatggccaagggcttctatatttccaagtccctgggcatcctggggatcctcctgggcgtggcagccgtgtgcacaatcatcgcactgtcagtggtgtactcccaggagaagaacaagaacgccaacagctcccccgtggcctccaccaccccgtccgcctcagccaccaccaaccccgcctcggccaccaccttggaccaaagtaaagcgtggaatcgttaccgcctccccaacacgctgaaacccgattcctaccaggtgacgctgagaccgtacctcacccccaatgacaggggcctgtacgtttttaagggctccagcaccgtccgtttcacctgcaaggaggccactgacgtcatcatcatccacagcaagaagctcaactacaccctcagccaggggcacagggtggtcctgcgtggtgtgggaggctcccagccccccgacattgacaagactgagctggtggagcccaccgagtacctggtggtgcacctcaagggctccctggtgaaggacagccagtatgagatggacagcgagttcgagggggagttggcagatgacctggcgggcttctaccgcagcgagtacatggagggcaatgtcagaaaggtggtggccactacacagatgcaggctgcagatgcccggaagtccttcccatgcttcgatgagccggccatgaaggccgagttcaacatcacgcttatccaccccaaggacctgacagccctgtccaacatgcttcccaaaggtcccagcaccccacttccagaagaccccaactggaatgtcactgagttccacaccacgcccaagatgtccacgtacttgctggccttcattgtcagtgagttcgactacgtggagaagcaggcatccaatggtgtcttgatccggatctgggcccggcccagtgccattgcggcgggccacggcgattatgccctgaacgtgacgggccccatccttaacttctttgctggtcattatgacacaccctacccactcccaaaatcagaccagattggcctgccagacttcaacgccggcgccatggagaactggggactggtgacctaccgggagaactccctgctgttcgaccccctgtcctcctccagcagcaacaaggagcgggtggtcactgtgattgctcatgagctggcccaccagtggttcgggaacctggtgaccatagagtggtggaatgacctgtggctgaacgagggcttcgcctcctacgtggagtacctgggtgctgactatgcggagcccacctggaacttgaaagacctcatggtgctgaatgatgtgtaccgcgtgatggcagtggatgcactggcctcctcccacccgctgtccacacccgcctcggagatcaacacgccggcccagatcagtgagctgtttgacgccatctcctacagcaagggcgcctcagtcctcaggatgctctccagcttcctgtccgaggacgtattcaagcagggcctggcgtcctacctccacacctttgcctaccagaacaccatctacctgaacctgtgggaccacctgcaggaggctgtgaacaaccggtccatccaactccccaccaccgagcgggacatcatgaaccgctggaccctgcagatgggcttcccggtcatcacggtggataccagcacggggaccctttcccaggagcacttcctccttgaccccgattccaatgttacccgcccctcagaattcaactacgtgtggattgtgcccatcacatccatcagagatggcagacagcagcaggactactggctgatggatgtaagagcccagaacgatctcttcagcacatcaggcaatgagtgggtcctgctgaacctcaatgtgacgggctattaccgggtgaactacgacgaagagaactggaggaagattcagactcagctgcagagagaccactcggccatccctgtcatcaatcgggcacagatcattaatgacgccttcaacctggccagtgcccataaggtccctgtcactctggcgctgaacaacaccctcttcctgattgaagagagacagtacatgccctgggaggccgccctgagcagcctgagctacttcaagctcatgtttgaccgctccgaggtctatggccccatgaagaactacctgaagaagcaggtcacacccctcttcattcacttcagaaataataccaacaactggagggagatcccagaaaacctgatggaccagtacagcgaggttaatgccatcagcaccgcctgctccaacggagttccagagtgtgaggagatggtctctggccttttcaagcagtggatggagaaccccaataataacccgatccaccccaacctgcggtccaccgtctactgcaacgctatcgcccagggcggggaggaggagtgggacttcgcctgggagcagttccgaaatgccacactggtcaatgaggctgacaagctccgggcagccctggcctgcagcaaagagttgtggatcctgaacaggtacctgagctacaccctgaacccggacttaatccggaagcaggacgccacctctaccatcatcagcattaccaacaacgtcattgggcaaggtctggtctgggactttgtccagagcaactggaagaagccttttaacgattatggtggtggctcgttctccttctccaacctcatccaggcagtgacacgacgattctccaccgagtatgagctgcagcagctggagcagttcaagaaggacaacgaggaaacaggcttcggctcaggcacccgggccctggagcaagccctggagaagacgaaagccaacatcaagtgggtgaaggagaacaaggaggtggtgctccagtggttcacagaaaacagcaaatagtccccagcccttgaagctacccggccccgatcgaaggtgcccacatgtgtccatcccagcggctggtgcagggcctccattc

SEQ ID NO: 14 - protein, 967 aa, Homo sapiens [sequence omitted]

SEQ ID NO: 15 - DNA, 398 bp, Homo sapiens
gatgctggggctggtcctggccttgctgtcctccagctctgctgaggagtacgtgggcctgtctgcaaaccagtgtgccgtgccggccaaggacagggtggactgcggctacccccatgtcacccccaaggagtgcaacaaccggggctgctgctttgactccaggatccctggagtgccttggtgtttcaagcccctgactaggaagacagaatgcaccttctgaggcacctccagctgcccctgggatgcaggctgagcacccttgcccggctgtgattgctgccaggcactgttcatctcagtttttctgtccctttgctcccggcaagctttctgctgaaagttcatatctggagcctgatgtcttaacgaataaaggtcccatgctccacccg

SEQ ID NO: 16 - protein, 74 aa, Homo sapiens
MLGLVLALLSSSSAEEYVGLSANQCAVPAKDRVDCGYPHVTPKECNNRGCCFDSRIPGVPWCFKPLTRKTECTF

SEQ ID NO: 17 - DNA, 1192 bp, Homo sapiens
ccagcccgaaaggcagggtctgggtgcgggaagagggctcggagctgccttcctgctgccttggggccgcccagatgagggaacagcccgatttgcctggttctgattctccaggctgtcgtggttgtggaatgcaaacgccagcacataatggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctgaatgcattggccggtgcccggctcatggtctgggggatgcaggcaggggaagggcagagatggcttctcagatatggcttgcaaaaaaaaaaaaaaaaaaa

SEQ ID NO: 18 - protein, 313 aa, Homo sapiens
METGPEDPSSMPEESSPRRTPQSIPYQDLPHLVNADGQYLFCRYWKPTGTPKALIFVSHGAGEHSGRYEELARMLMGLDLLVFAHDHVGHGQSEGERMVVSDFHVFVRDVLQHVDSMQKDYPGLPVFLLGHSMGGAIAILTAAERPGHFAGMVLISPLVLANPESATTFKVLAAKVLNLVLPNLSLGPIDSSVLSRNKTEVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 19 - DNA, 1104 bp, Homo sapiens
ctcggtgcgcgaccccggctcagaggactctttgctgtcccgcaagatgcggatgctgctggcgctcctggccctctccgcggcgcggccatcggccagtgcagagtcacactggtgctacgaggttcaagccgagtcctccaactacccctgcttggtgccagtcaagtggggtggaaactgccagaaggaccgccagtcccccatcaacatcgtcaccaccaaggcaaaggtggacaaaaaactgggacgcttcttcttctctggctacgataagaagcaaacgtggactgtccaaaataacgggcactcagtgatgatgttgctggagaacaaggccagcatttctggaggaggactgcctgccccataccaggccaaacagttgcacctgcactggtccgacttgccatataagggctcggagcacagcctcgatggggagcactttgccatggagatgcacatagtacatgagaaagagaaggggacatcgaggaatgtgaaagaggcccaggaccctgaagacgaaattgcggtgctggcctttctggtggaggctggaacccaggtgaacgagggcttccagccactggtggaggcactgtctaatatccccaaacctgagatgagcactacgatggcagagagcagcctgttggacctgctccccaaggaggagaaactgaggcactacttccgctacctgggctcactcaccacaccgacctgcgatgagaaggtcgtctggactgtgttccgggagcccattcagcttcacagagaacagatcctggcattctctcagaagctgtactacgacaaggaacagacagtgagcatgaaggacaatgtcaggcccctgcagcagctggggcagcgcacggtgataaagtccggggccccgggtcggccgctgccctgggccctgcctgccctgctgggccccatgctggcctgcctgctggccggcttcctgcgatgatggctcacttctgcacgcagcctctctgttgcctcagctctccaagttccaggcttccggtccttagccttcccaggtgggactttaggcatgattaaaatatggacatatttttggag

SEQ ID NO: 20 - protein, 312 aa, Homo sapiens
MRMLLALLALSAARPSASAESHWCYEVQAESSNYPCLVPVKWGGNCQKDRQSPINIVTTKAKVDKKLGRFFFSGYDKKQTWTVQNNGHSVMMLLENKASISGGGLPAPYQAKQLHLHWSDLPYKGSEHSLDGEHFAMEMHIVHEKEKGTSRNVKEAQDPEDEIAVLAFLVEAGTQVNEGFQPLVEALSNIPKPEMSTTMAESSLLDLLPKEEKLRHYFRYLGSLTTPTCDEKVVWTVFREPIQLHREQILAFSQKLYYDKEQTVSMKDNVRPLQQLGQRTVIKSGAPGRPLPWALPALLGPMLACLLAGFLR

SEQ ID NO: 21 - DNA, 2814 bp, Homo sapiens
  misc_feature (1): Where n is G or A or T or C
  misc_feature (3): Where n is G or A or T or C
ngnacacgtccaacgccagcatgcagcgcccgggcccccgcctgtggctggtcctgcaggtgatgggctcgtgcgccgccatcagctccatggacatggagcgcccgggcgacggcaaatgccagcccatcgagatcccgatgtgcaaggacatcggctacaacatgactcgtatgcccaacctgatgggccacgagaaccagcgcgaggcagccatccagttgcacgagttcgcgccgctggtggagtacggctgccacggccacctccgcttcttcctgtgctcgctgtacgcgccgatgtgcaccgagcaggtctctacccccatccccgcctgccgggtcatgtgcgagcaggcccggctcaagtgctccccgattatggagcagttcaacttcaagtggcccgactccctggactgccggaaactccccaacaagaacgaccccaactacctgtgcatggaggcgcccaacaacggctcggacgagcccacccggggctcgggcctgttcccgccgctgttccggccgcagcggccccacagcgcgcaggagcacccgctgaaggacgggggccccgggcgcggcggctgcgacaacccgggcaagttccaccacgtggagaagagcgcgtcgtgcgcgccgctctgcacgcccggcgtggacgtgtactggagccgcgaggacaagcgcttcgcagtggtctggctggccatctgggcggtgctgtgcttcttctccagcgccttcaccgtgctcaccttcctcatcgacccggcccgcttccgctaccccgagcgccccatcatcttcctctccatgtgctactgcgtctactccgtgggctacctcatccgcctcttcgccggcgccgagagcatcgcctgcgaccgggacagcggccagctctatgtcatccaggagggactggagagcaccggctgcacgctggtcttcctggtcctctactacttcggcatggccagctcgctgtggtgggtggtcctcacgctcacctggttcctggccgccggcaagaagtggggccacgaggccatcgaagccaacagcagctacttccacctggcagcctgggccatcccggcggtgaagaccatcctgatcctggtcatgcgcagggtggcgggggacgagctcaccggggtctgctacgtgggcagcatggacgtcaacgcgctcaccggcttcgtgctcattcccctggcctgctacctggtcatcggcacgtccttcatcctctcgggcttcgtggccctgttccacatccggagggtgatgaagacgggcggcgagaacacggacaagctggagaagctcatggtgcgtatcgggctcttctctgtgctgtacaccgtgccggccacctgtgtgatcgcctgctacttttacgaacgcctcaacatggattactggaagatcctggcggcgcagcacaagtgcaaaatgaacaaccagactaaaacgctggactgcctgatggccgcctccatccccgccgtggagatcttcatggtgaagatctttatgctgctggtggtggggatcaccagcgggatgtggatttggacctccaagactctgcagtcctggcagcaggtgtgcagccgtaggttaaagaagaagagccggagaaaaccggccagcgtgatcaccagcggtgggatttacaaaaaagcccagcatccccagaaaactcaccacgggaaatatgagatccctgcccagtcgcccacctgcgtgtgaacagggctggagggaagggcacaggggcgcccggagctaagatgtggtgcttttcttggttgtgtttttctttcttcttcttcttttttttttttttataaaagcaaaagagaaatacataaaaaagtgtttaccctgaaattcaggatgctgtgatacactgaaaggaaaaatgtacttaaagggttttgttttgttttggttttccagcgaagggaagctcctccagtgaagtagcctcttgtgtaactaatttgtggtaaagtagttgattcagccctcagaagaaaacttttgtttagagccctccgtaaatatacatctgtgtatttgagttggctttgctacccatttacaaataagaggacagataactgctttgcaaattcaagagcctcccctgggttaacaaatgagccatccccagggcccacccccaggaaggccacagtgctgggcggcatccctgcagaggaaagacaggacccggggcccgcctcacaccccagtggatttggagttgcttaaaatagactctggccttcaccaatagtctctctgcaagacagaaacctccatcaaacctcacatttgtgaactcaaacgatgtgcaatacatttttttctctttccttgaaaataaaaagagaaacaagtattttgctatatataaagacaacaaaagaaatctcctaacaaaagaactaagaggcccagccctcagaaacccttcagtgctacattttgtggctttttaatggaaaccaagccaatgttatagacgtttggactgatttgtggaaaggaggggggaagagggagaaggatcattcaaaagttacccaaagggcttattgactctttctattgttaaacaaatgatttccacaaacagatcaggaagcactaggttggcagagacactttgtctagtgtattctcttcacagtgccaggaaagagtggtttctgcgtgtgtatatttgtaatatatgatatttttcatgctccactattttattaaaaataaaatatgttctttaaaaaaa

SEQ ID NO: 22 - protein, 581 aa, Homo sapiens
MQRPGPRLWLVLQVMGSCAAISSMDMERPGDGKCQPIEIPMCKDIGYNMTRMPNLMGHENQREAAIQLHEFAPLVEYGCHGHLRFFLCSLYAPMCTEQVSTPIPACRVMCEQARLKCSPIMEQFNFKWPDSLDCRKLPNKNDPNYLCMEAPNNGSDEPTRGSGLFPPLFRPQRPHSAQEHPLKDGGPGRGGCDNPGKFHHVEKSASCAPLCTPGVDVYWSREDKRFAVVWLAIWAVLCFFSSAFTVLTFLIDPARFRYPERPIIFLSMCYCVYSVGYLIRLFAGAESIACDRDSGQLYVIQEGLESTGCTLVFLVLYYFGMASSLWWVVLTLTWFLAAGKKWGHEAIEANSSYFHLAAWAIPAVKTILILVMRRVAGDELTGVCYVGSMDVNALTGFVLIPLACYLVIGTSFILSGFVALFHIRRVMKTGGENTDKLEKLMVRIGLFSVLYTVPATCVIACYFYERLNMDYWKILAAQHKCKMNNQTKTLDCLMAASIPAVEIFMVKIFMLLVVGITSGMWIWTSKTLQSWQQVCSRRLKKKSRRKPASVITSGGIYKKAQHPQKTHHGKYEIPAQSPTCV

SEQ ID NO: 23 - DNA, 2840 bp, Homo sapiens
cagcggccgctgaattctagggcgggttcgcgccccgaaggctgagagctggcgctgctcgtgccctgtgtgccagacggcggagctccgcggccggaccccgcggccccgctttgctgccgactggagtttgggggaagaaactctcctgcgccccagaagatttcttcctcggcgaagggacagcgaaagatgagggtggcaggaagagaaggcgctttctgtctgccggggtcgcagcgcgagagggcagtgccatgttcctctccatcctagtggcgctgtgcctgtggctgcacctggcgctgggcgtgcgcggcgcgccctgcgaggcggtgcgcatccctatgtgccggcacatgccctggaacatcacgcggatgcccaaccacctgcaccacagcacgcaggagaacgccatcctggccatcgagcagtacgaggagctggtggacgtgaactgcagcgccgtgctgcgcttcttcttctgtgccatgtacgcgcccatttgcaccctggagttcctgcacgaccctatcaagccgtgcaagtcggtgtgccaacgcgcgcgcgacgactgcgagcccctcatgaagatgtacaaccacagctggcccgaaagcctggcctgcgacgagctgcctgtctatgaccgtggcgtgtgcatttcgcctgaagccatcgtcacggacctcccggaggatgttaagtggatagacatcacaccagacatgatggtacaggaaaggcctcttgatgttgactgtaaacgcctaagccccgatcggtgcaagtgtaaaaaggtgaagccaactttggcaacgtatctcagcaaaaactacagctatgttattcatgccaaaataaaagctgtgcagaggagtggctgcaatgaggtcacaacggtggtggatgtaaaagagatcttcaagtcctcatcacccatccctcgaactcaagtcccgctcattacaaattcttcttgccagtgtccacacatcctgccccatcaagatgttctcatcatgtgttacgagtggcgttcaaggatgatgcttcttgaaaattgcttagttgaaaaatggagagatcagcttagtaaaagatccatacagtgggaagagaggctgcaggaacagcggagaacagttcaggacaagaagaaaacagccgggcgcaccagtcgtagtaatccccccaaaccaaagggaaagcctcctgctcccaaaccagccagtcccaagaagaacattaaaactaggagtgcccagaagagaacaaacccgaaaagagtgtgagctaactagtttccaaagcggagacttccgacttccttacaggatgaggctgggcattgcctgggacagcctatgtaaggccatgtgccccttgccctaacaactcactgcagtgctcttcatagacacatcttgcagcatttttcttaaggctatgcttcagtttttctttgtaagccatcacaagccatagtggtaggtttgccctttggtacagaaggtgagttaaagctggtggaaaaggcttattgcattgcattcagagtaacctgtgtgcatactctagaagagtagggaaaataatgcttgttacaattcgacctaatatgtgcattgtaaaataaatgccatatttcaaacaaaacacgtaatttttttacagtatgttttattaccttttgatatctgttgttgcaatgttagtgatgttttaaaatgtgatgaaaatataatgtttttaagaaggaacagtagtggaatgaatgttaaaagatctttatgtgtttatggtctgcagaaggatttttgtgatgaaaggggattttttgaaaaattagagaagtagcatatggaaaattataatgtgtttttttaccaatgacttcagtttctgtttttagctagaaacttaaaaacaaaaataataataaagaaaaataaataaaaaggagaggcagacaatgtctggattcctgttttttggttacctgatttccatgatcatgatgcttcttgtcaacaccctcttaagcagcaccagaaacagtgagtttgtctgtaccattaggagttaggtactaattagttggctaatgctcaagtattttatacccacaagagaggtatgtcactcatcttacttcccaggacatccaccctgagaataatttgacaagcttaaaaatggccttcatgtgagtgccaaattttgtttttcttcatttaaatattttctttgcctaaatacatgtgagaggagttaaatataaatgtacagagaggaaagttgagttccacctctgaaatgagaattacttgacagttgggatactttaatcagaaaaaaagaacttatttgcagcattttatcaacaaatttcataattgtggacaattggaggcatttattttaaaaaacaattttattggccttttgctaacacagtaagcatgtattttataaggcattcaataaatgcacaacgcccaaaggaaataaaatcctatctaatcctactctccactacacagaggtaatcactattagtattttggcatattattctccaggtgtttgcttatgcacttataaaatgatttgaacaaataaaactaggaacctgtatacatgtgtttcataacctgcctcctttgcttggccctttattgagataagttttcctgtcaagaaagcagaaaccatctcatttctaacagctgtgttatattccatagtatgcattactcaacaaactgttgtgctattggatacttaggtggtttcttcactgacaatactgaataaacatctcaccggaattc

SEQ ID NO: 24 - protein, 346 aa, Homo sapiens
MFLSILVALCLWLHLALGVRGAPCEAVRIPMCRHMPWNITRMPNHLHHSTQENAILAIEQYEELVDVNCSAVLRFFFCAMYAPICTLEFLHDPIKPCKSVCQRARDDCEPLMKMYNHSWPESLACDELPVYDRGVCISPEAIVTDLPEDVKWIDITPDMMVQERPLDVDCKRLSPDRCKCKKVKPTLATYLSKNYSYVIHAKIKAVQRSGCNEVTTVVDVKEIFKSSSPIPRTQVPLITNSSCQCPHILPHQDVLIMCYEWRSRMMLLENCLVEKWRDQLSKRSIQWEERLQEQRRTVQDKKKTAGRTSRSNPPKPKGKPPAPKPASPKKNIKTRSAQKRTNPKRV

SEQ ID NO: 25 - DNA, 3445 bp, Homo sapiens
caccgcgtgttcgcgcctggtagagatttctcgaagacaccagtgggcccgtgtggaaccaaacctgcgcgcgtggccgggccgtgggacaacgaggccgcggagacgaaggcgcaatggcgaggaagttatctgtaatcttgatcctgacctttgccctctctgtcacaaatccccttcatgaactaaaagcagctgctttcccccagaccactgagaaaattagtccgaattgggaatctggcattaatgttgacttggcaatttccacacggcaatatcatctacaacagcttttctaccgctatggagaaaataattctttgtcagttgaagggttcagaaaattacttcaaaatataggcatagataagattaaaagaatccatatacaccatgaccacgaccatcactcagaccacgagcatcactcagaccatgagcgtcactcagaccatgagcatcactcagagcacgagcatcactctgaccatgatcatcactctcaccataatcatgctgcttctggtaaaaataagcgaaaagctctttgcccagaccatgactcagatagttcaggtaaagatcctagaaacagccaggggaaaggagctcaccgaccagaacatgccagtggtagaaggaatgtcaaggacagtgttagtgctagtgaagtgacctcaactgtgtacaacactgtctctgaaggaactcactttctagagacaatagagactccaagacctggaaaactcttccccaaagatgtaagcagctccactccacccagtgtcacatcaaagagccgggtgagccggctggctggtaggaaaacaaatgaatctgtgagtgagccccgaaaaggctttatgtattccagaaacacaaatgaaaatcctcaggagtgtttcaatgcatcaaagctactgacatctcatggcatgggcatccaggttccgctgaatgcaacagagttcaactatctctgtccagccatcatcaaccaaattgatgctagatcttgtctgattcatacaagtgaaaagaaggctgaaatccctccaaagacctattcattacaaatagcctgggttggtggttttatagccatttccatcatcagtttcctgtctctgctgggggttatcttagtgcctctcatgaatcgggtgtttttcaaatttctcctgagtttccttgtggcactggccgttgggactttgagtggtgatgcttttttacaccttcttccacattctcatgcaagtcaccaccatagtcatagccatgaagaaccagcaatggaaatgaaaagaggaccacttttcagtcatctgtcttctcaaaacatagaagaaagtgcctattttgattccacgtggaagggtctaacagctctaggaggcctgtatttcatgtttcttgttgaacatgtcctcacattgatcaaacaatttaaagataagaagaaaaagaatcagaagaaacctgaaaatgatgatgatgtggagattaagaagcagttgtccaagtatgaatctcaactttcaacaaatgaggagaaagtagatacagatgatcgaactgaaggctatttacgagcagactcacaagagccctcccactttgattctcagcagcctgcagtcttggaagaagaagaggtcatgatagctcatgctcatccacaggaagtctacaatgaatatgtacccagagggtgcaagaataaatgccattcacatttccacgatacactcggccagtcagacgatctcattcaccaccatcatgactaccatcatattctccatcatcaccaccaccaaaaccaccatcctcacagtcacagccagcgctactctcgggaggagctgaaagatgccggcgtcgccactctggcctggatggtgataatgggtgatggcctgcacaatttcagcgatggcctagcaattggtgctgcttttactgaaggcttatcaagtggtttaagtacttctgttgctgtgttctgtcatgagttgcctcatgaattaggtgactttgctgttctactaaaggctggcatgaccgttaagcaggctgtcctttataatgcattgtcagccatgctggcgtatcttggaatggcaacaggaattttcattggtcattatgctgaaaatgtttctatgtggatatttgcacttactgctggcttattcatgtatgttgctctggttgatatggtacctgaaatgctgcacaatgatgctagtgaccatggatgtagccgctgggggtatttctttttacagaatgctgggatgcttttgggttttggaattatgttacttatttccatatttgaacataaaatcgtgtttcgtataaatttctagttaaggtttaaatgctagagtagcttaaaaagttgtcatagtttcagtaggtcatagggagatgagtttgtatgctgtactatgcagcgtttaaagttagtgggttttgtgatttttgtattgaatattgctgtctgttacaaagtcagttaaaggtacgttttaatatttaagttattctatcttggagataaaatctgtatgtgcaattcaccggtattaccagtttattatgtaaacaagagatttggcatgacatgttctgtatgtttcagggaaaaatgtctttaatgctttttcaagaactaacacagttattcctatactggattttaggtctctgaagaactgctggtgtttaggaataagaatgtgcatgaagcctaaaataccaagaaagcttatactgaatttaagcaaagaaataaaggagaaaagagaagaatctgagaattggggaggcatagattcttataaaaatcacaaaatttgttgtaaattagaggggagaaatttagaattaagtataaaaaggcagaattagtatagagtacattcattaaacatttttgtcaggattatttcccgtaaaaacgtagtgagcacttttcatatactaatttagttgtacatttaactttgtataatacagaaatctaaatatatttaatgaattcaagcaatatatcacttgaccaagaaattggaatttcaaaatgttcgtgcgggtatataccagatgagtacagtgagtagttttatgtatcaccagactgggttattgccaagttatatatcaccaaaagctgtatgactggatgttctggttacctggtttacaaaattatcagagtagtaaaactttgatatatatgaggatattaaaactacactaagtatcatttgattcgattcagaaagtactttgatatctctcagtgcttcagtgctatcattgtgagcaattgtcttttatatacggtactgtagccatactaggcctgtctgtggcattctctagatgtttcttttttacacaataaattccttatatcagcttg

SEQ ID NO: 26 - protein, 755 aa, Homo sapiens
MARKLSVILILTFALSVTNPLHELKAAAFPQTTEKISPNWESGINVDLAISTRQYHLQQLFYRYGENNSLSVEGFRKLLQNIGIDKIKRIHIHHDHDHHSDHEHHSDHERHSDHEHHSEHEHHSDHDHHSHHNHAASGKNKRKALCPDHDSDSSGKDPRNSQGKGAHRPEHASGRRNVKDSVSASEVTSTVYNTVSEGTHFLETIETPRPGKLFPKDVSSSTPPSVTSKSRVSRLAGRKTNESVSEPRKGFMYSRNTNENPQECFNASKLLTSHGMGIQVPLNATEFNYLCPAIINQIDARSCLIHTSEKKAEIPPKTYSLQIAWVGGFIAISIISFLSLLGVILVPLMNRVFFKFLLSFLVALAVGTLSGDAFLHLLPHSHASHHHSHSHEEPAMEMKRGPLFSHLSSQNIEESAYFDSTWKGLTALGGLYFMFLVEHVLTLIKQFKDKKKKNQKKPENDDDVEIKKQLSKYESQLSTNEEKVDTDDRTEGYLRADSQEPSHFDSQQPAVLEEEEVMIAHAHPQEVYNEYVPRGCKNKCHSHFHDTLGQSDDLIHHHHDYHHILHHHHHQNHHPHSHSQRYSREELKDAGVATLAWMVIMGDGLHNFSDGLAIGAAFTEGLSSGLSTSVAVFCHELPHELGDFAVLLKAGMTVKQAVLYNALSAMLAYLGMATGIFIGHYAENVSMWIFALTAGLFMYVALVDMVPEMLHNDASDHGCSRWGYFFLQNAGMLLGFGIMLLISIFEHKIVFRINF

SEQ ID NO: 27 - DNA, 3851 bp, Homo sapiens
agactggggtgggggaggggttcaggcctgttccccgcggctgcggcagcaccagggccggccgccaccgcctctagaacgcggaggaggtgggtcctgggaagcgggatgtccatcgctccagcttggtggtgaatgctgaggagagtcactgttgctgcagtctgtgccacccggaggaagttgtgtgaggccgggcgggacgtcgcggcgctctggggaatcgaaacgcggggtcggtgcgaagactctgctgctgccagaccctttcctattctggccatgcctggaaggaacaaggcgaagtctacctgcagctgccctgacctgcagcccaatggacaggatctgggcgagaacagccgggttgcccgtctaggagcggatgaatctgaggaagagggacggagggggtctctcagtaatgctggggaccctgagatcgtcaagtctcccagcgaccccaagcaataccgatacatcaaattacagaatggcctacaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagcaattgcagagcctgtttttgctgtggtcaaagctgactgatagactgtggtttaagtcaacttattcaaaaatgtcttcaaccctgctggtcgagacaagaaatctttatggggtagttggagctgaaagcaggtctgcacctgttcagcatttggcaggatggcaagcggaggagcagcagggtgaaactgacacagttctgtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggccatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttctgtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggcagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcctgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggctcatagagggccaggaagtaaaatgctcagcgttcatgttgttgggtatgggaagtatgaactggaagaggatggatccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataaataaactgcagtcacgttggcctgaaaaaaaaaaaaaaaaaaaaaaaaaaaaaaaa

SEQ ID NO: 28 - protein, 1219 aa, Homo sapiens
MLRRVTVAAVCATRRKLCEAGRDVAALWGIETRGRCEDSAAARPFPILAMPGRNKAKSTCSCPDLQPNGQDLGENSRVARLGADESEEEGRRGSLSNAGDPEIVKSPSDPKQYRYIKLQNGLQALLISDLSNMEGKTGNTTDDEEEEEVEEEEEDDDEDSGAEIEDDDEEGFDDEDEFDDEHDDDLDTEDNELEELEERAEARKKTTEKQQLQSLFLLWSKLTDRLWFKSTYSKMSSTLLVETRNLYGVVGAESRSAPVQHLAGWQAEEQQGETDTVLSAAALCVGVGSFADPDDLPGLAHFLEHMVFMGSLKYPDENGFDAFLKKHGGSDNASTDCERTVFQFDVQRKYFKEALDRWAQFFIHPLMIRDAIDREVEAVDSEYQLARPSDANRKEMLFGSLARPGHPMGKFFWGNAETLKHEPRKNNIDTHARLREFWMRYYSSHYMTLVVQSKETLDTLEKWVTEIFSQIPNNGLPRPNFGHLTDPFDTPAFNKLYRVVPIRKIHALTITWALPPQQQHYRVKPLHYISWLVGHEGKGSILSFLRKKCWALALFGGNGETGFEQNSTYSVFSISITLTDEGYEHFYEVAYTVFLYLKMLQKLGPEKRIFEEIRKIEDNEFHYQEQTDPVEYVENMCENMQLYPLQDILTGDQLLFEYKPEVIGEALNQLVPQKANLVLLSGANEGKCDLKEKWFGTQYSIEDIENSWAELWNSNFELNPDLHLPAENKYIATDFTLKAFDCPETEYPVKIVNTPQGCLWYKKDNKFKIPKAYIRFHLISPLIQKSAANVVLFDIFVNILTHNLAEPAYEADVAQLEYKLAAGEHGLIIRVKGFNHKLPLLFQLIIDYLAEFNSTPAVFTMITEQLKKTYFNILIKPETLAKDVRLLILEYARWSMIDKYQALMDGLSLESLLSFVKEFKSQLFVEGLVQGNVTSTESMDFLKYVVDKLNFKPLEQEMPVQFQVVELPSGHHLCKVKALNKGDANSEVTVYYQSGTRSLREYTLMELLVMHMEEPCFDFLRTKQTLGYHVYPTCRNTSGILGFSVTVGTQATKYNSEVVDKKIEEFLSSFEEKIENLTEEAFNTQVTALIKLKECEDTHLGEEVDRNWNEVVTQQYLFDRLAHEIEALKSFSKSDLVNWFKAHRGPGSKMLSVHVVGYGKYELEEDGSPSSEDSNSSCEVMQLTYLPTSPLLADCIIPITDIRAFTTTLNLLPYHKIVK

SEQ ID NO: 29 - DNA, 2038 bp, Homo sapiens
gttttcagaatgattttattcaagcaagcaacttatttcatttccttgtttgctacagtttcctgtggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtttggttgcttcttgaaagatagtgttacaggaaccctgccaaaagtacatcgaacaggtgcagtttctggacattccttgaagcaatgtggtcatcaaataagtgcttgccatcgagacatttataaaggagttgatatgagaggagtcaattttaatgtgtctaaggttagcagtgttgaagaatgccaaaaaaggtgcaccaataacattcgctgccagtttttttcatatgccacgcaaacatttcacaaggcagagtaccggaacaattgcctattaaagtacagtcccggaggaacacctaccgctataaaggtgctgagtaacgtggaatctggattctcactgaagccctgtgccctttcagaaattggttgccacatgaacatcttccagcatcttgcgttctcagatgtggatgttgccaggtttctcactccagatgcttttgtgtgtcggaccatctgcacctatcaccccaactgcctcttctttacattctatacaaatgtatggaaaatcgagtcacaaagaaatgtttgtcttcttaaaacatctgaaagtggcacaccaagttcctctactcctcaagaaaacaccatatctggatatagccttttaacctgcaaaagaactttacctgaaccctgccattctaaaatttacccgggagttgactttggaggagaagaattgaatgtgacttttgttaaaggagtgaatgtttgccaagagacttgcacaaagatgattcgctgtcagtttttcacttattctttactcccagaagactgtaaggaagagaagtgtaagtgtttcttaagattatctatggatggttctccaactaggattgcgtatgggacacaagggagctctggttactctttgagattgtgtaacactggggacaacgctgtctgcacaacaaaaacaagcacacgcattgttggaggaacaaactcttcttggggagagtggccctggcaggtgagcctgcaggtgaagctgacagctcagaggcacctgtgtggagggtcactcataggacaccagtgggtcctcactgctgcccactgctttgatgggcttcccctgcaggatgtttggcgcatctatagtggcattttaaatctgtcagacattacaaaagatacacctttctcacaaataaaagagattattattcaccaaaactataaagtctcagaagggaatcatgatatcgccttgataaaactccaggctcctttgaattacactgaattccaaaaaccaatatgcctaccttccaaaggtgacacaagcacaatttataccaactgttgggtaaccggatggggcttctcgaaggagaaaggtgaaatccaaaatattctacaaaaggtaaatattcctttggtaacaaatgaagaatgccagaaaagatatcaagattataaaataacccaacggatggtctgtgctggctataaagaagggggaaaagatgcttgtaagggagattcaggtggtcccttagtttgcaaacacaacggaatgtggcgtttggtgggcatcaccagctggggtgaaggctgtgcccgcagggagcaacctggtgtctacaccaaagtcgctgagtacatggactggattttagagaaaacacagagcagtgatggaaaagctcagatgcagtcaccagcatgagaagcagtccagagtctaggcaatttttacaacctgagttcaagtcaaattctgagcctggggggtcctcatctgcaaagcatgaagagtggcatcttctttgcatcctaag

SEQ ID NO: 30 - protein, 638 aa, Homo sapiens
MILFKQATYFISLFATVSCGCLTQLYENAFFRGGDVASMYTPNAQYCQMRCTFHPRCLLFSFLPASSINDMEKRFGCFLKDSVTGTLPKVHRTGAVSGHSLKQCGHQISACHRDIYKGVDMRGVNFNVSKVSSVEECQKRCTNNIRCQFFSYATQTFHKAEYRNNCLLKYSPGGTPTAIKVLSNVESGFSLKPCALSEIGCHMNIFQHLAFSDVDVARFLTPDAFVCRTICTYHPNCLFFTFYTNVWKIESQRNVCLLKTSESGTPSSSTPQENTISGYSLLTCKRTLPEPCHSKIYPGVDFGGEELNVTFVKGVNVCQETCTKMIRCQFFTYSLLPEDCKEEKCKCFLRLSMDGSPTRIAYGTQGSSGYSLRLCNTGDNAVCTTKTSTRIVGGTNSSWGEWPWQVSLQVKLTAQRHLCGGSLIGHQWVLTAAHCFDGLPLQDVWRIYSGILNLSDITKDTPFSQIKEIIIHQNYKVSEGNHDIALIKLQAPLNYTEFQKPICLPSKGDTSTIYTNCWVTGWGFSKEKGEIQNILQKVNIPLVTNEECQKRYQDYKITQRMVCAGYKEGGKDACKGDSGGPLVCKHNGMWRLVGITSWGEGCARREQPGVYTKVAEYMDWILEKTQSSDGKAQMQSPA

SEQ ID NO: 31 - DNA, 1094 bp, Homo sapiens
tcttccacctttctccattcctctaggtgctttttctgaacctggatgtgaggcattaaaggatccgacggaaatagaattgaaggcattctaaaatggctaaccgtacagtgaaggatgcgcacagcatccatggcaccaaccctcaatatctggtggagaagatcattcgaacgcgaatctatgagtccaagtactggaaagaggagtgctttggacttacagctgaacttgtagtcgataaagccatggagttaaggtttgtgggtggcgtctatggtggcaacataaaaccaacaccctttctgtgtttaaccttgaagatgcttcaaattcaacccgagaaggatatcattgtagagtttatcaaaaatgaagatttcaagtatgtccgcatgctgggggcactttacatgaggctgacaggcactgcaattgattgctacaagtacttggaacctttgtacaatgactatcgaaaaatcaagagccagaaccgaaatggggagtttgaattgatgcatgttgatgagtttattgatgaactattgcaaagtgagagagtctgtgatatcattctgccccgactacagaaacgctatgtattagaggaagctgagcaactggagcctcgagttagtgctctggaagaggacatggatgatgtggagtccagtgaagaggaagaagaggaggatgagaagttggaaagagtgccatcacctgatcaccgccggagaagctaccgagacttggacaagccccgtcgctctcccacactgcgctacaggaggagtaggagccggtctcccagaaggcggagtcgatctcccaaaaggagaagcccctcccctcgccgagaaaggcatcggagcaagagtccaagacgtcaccgcagcaggtcccgagatcggcggcacagatcccgttccaagtccccaggtcatcaccgtagtcacagacacaggagccactcaaagtctcccgaaaggtctaagaagagccacaagaagagccggagagggaatgagtaatggactcagtttggttttagtccacatggcctcctgtggatataaggatatctgtatgtg

SEQ ID NO: 32 - protein, 312 aa, Homo sapiens
MANRTVKDAHSIHGTNPQYLVEKIIRTRIYESKYWKEECFGLTAELVVDKAMELRFVGGVYGGNIKPTPFLCLTLKMLQIQPEKDIIVEFIKNEDFKYVRMLGALYMRLTGTAIDCYKYLEPLYNDYRKIKSQNRNGEFELMHVDEFIDELLQSERVCDIILPRLQKRYVLEEAEQLEPRVSALEEDMDDVESSEEEEEEDEKLERVPSPDHRRRSYRDLDKPRRSPTLRYRRSRSRSPRRRSRSPKRRSPSPRRERHRSKSPRRHRSRSRDRRHRSRSKSPGHHRSHRHRSHSKSPERSKKSHKKSRRGNE

SEQ ID NO: 33 - DNA, 3168 bp, Homo sapiens
cacaagacctggaattgacaggactcccaactagtacaatgacagaagataaggtcactgggaccctggttttcactgtcatcactgctgtgctgggttccttccagtttggatatgacattggtgtgatcaatgcacctcaacaggtaataatatctcactatagacatgttttgggtgttccactggatgaccgaaaagctatcaacaactatgttatcaacagtacagatgaactgcccacaatctcatactcaatgaacccaaaaccaaccccttgggctgaggaagagactgtggcagctgctcaactaatcaccatgctctggtccctgtctgtatccagctttgcagttggtggaatgactgcatcattctttggtgggtggcttggggacacacttggaagaatcaaagccatgttagtagcaaacattctgtcattagttggagctctcttgatggggttttcaaaattgggaccatctcatatacttataattgctggaagaagcatatcaggactatattgtgggctaatttcaggcctggttcctatgtatatcggtgaaattgctccaaccgctctcaggggagcacttggcacttttcatcagctggccatcgtcacgggcattcttattagtcagattattggtcttgaatttatcttgggcaattatgatctgtggcacatcctgcttggcctgtctggtgtgcgagccatccttcagtctctgctactctttttctgtccagaaagccccagatacctttacatcaagttagatgaggaagtcaaagcaaaacaaagcttgaaaagactcagaggatatgatgatgtcaccaaagatattaatgaaatgagaaaagaaagagaagaagcatcgagtgagcagaaagtctctataattcagctcttcaccaattccagctaccgacagcctattctagtggcactgatgctgcatgtggctcagcaattttccggaatcaatggcattttttactactcaaccagcatttttcagacggctggtatcagcaaacctgtttatgcaaccattggagttggcgctgtaaacatggttttcactgctgtctctgtattccttgtggagaaggcagggcgacgttctctctttctaattggaatgagtgggatgtttgtttgtgccatcttcatgtcagtgggacttgtgctgctgaataagttctcttggatgagttatgtgagcatgatagccatcttcctctttgtcagcttctttgaaattgggccaggcccgatcccctggttcatggtggctgagtttttcagtcaaggaccacgtcctgctgctttagcaatagctgcattcagcaattggacctgcaatttcattgtagctctgtgtttccagtacattgcggacttctgtggaccttatgtgtttttcctctttgctggagtgctcctggcctttaccctgttcacattttttaaagttccagaaaccaaaggaaagtcttttgaggaaattgctgcagaattccaaaagaagagtggctcagcccacaggccaaaagctgctgtagaaatgaaattcctaggagctacagagactgtgtaaaaaaaaaaccctgctttttgacatgaacagaaacaataagggaaccgtctgtttttaaatgatgattccttgagcattttatatccacatctttaagtattgttttatttttatgtgctctcatcagaaatgtcatcaaatattaccaaaaaagtatttttttaagttagagaatatatttttgatggtaagactgtaattaagtaaaccaaaaaggctagtttattttgttacactaaagggcaggtggttctaatatttttagctctgttctttataacaaggttcttctaaaattgaagagatttcaacatatcatttttttaacacataactagaaacctgaggatgcaacaaatatttatatatttgaatatcattaaattggaattttcttacccatatatcttatgttaaaggagatatggctagtggcaataagttccatgttaaaatagacaactcttccatttattgcactcagcttttttcttgagtactagaatttgtattttgcttaaaattttacttttgttctgtattttcatgtggaatggattatagagtatactaaaaaatgtctatagagaaaaactttcatttttggtaggcttatcaaaatctttcagcactcagaaaagaaaaccattttagttcctttatttaatggccaaatggtttttgcaagatttaacactaaaaaggtttcacctgatcatatagcgtgggttatcagttaacattaacatctattataaaaccatgttgattcccttctggtacaatcctttgagttatagtttgctttgctttttaattgaggacagcctggttttcacatacactcaaacaatcatgagtcagacatttggtatattacctcaaattcctaataagtttgatcaaatctaatgtaagaaaatttgaagtaaaggattgatcactttgttaaaaatattttctgaattattatgtctcaaaataagttgaaaaggtagggtttgaggattcctgagtgtgggcttctgaaacttcataaatgttcagcttcagacttttatcaaaatccctatttaattttcctggaaagactgattgttttatggtgtgttcctaacataaaataatcgtctcctttgacatttccttctttgtcttagctgtatacagattctagccaaactattctatggccattactaacacgcattgtacactatctatctgcctttacctacataggcaaattggaaatacacagatgattaaacagactttagcttacagtcaattttacaattatggaaatatagttctgatgggtcccaaaagcttagcagggtgctaacgtatctctaggctgttttctccaccaactggagcactgatcaatccttcttatgtttgctttaatgtgtattgaagaaaagcactttttaaaaagtactctttaagagtgaaataattaaaaaccactgaacatttgctttgttttctaaagttgttcacatatatgtaatttagcagtccaaagaacaagaaattgtttcttttc

SEQ ID NO: 34 - protein, 524 aa, Homo sapiens
MTEDKVTGTLVFTVITAVLGSFQFGYDIGVINAPQQVIISHYRHVLGVPLDDRKAINNYVINSTDELPTISYSMNPKPTPWAEEETVAAAQLITMLWSLSVSSFAVGGMTASFFGGWLGDTLGRIKAMLVANILSLVGALLMGFSKLGPSHILIIAGRSISGLYCGLISGLVPMYIGEIAPTALRGALGTFHQLAIVTGILISQIIGLEFILGNYDLWHILLGLSGVRAILQSLLLFFCPESPRYLYIKLDEEVKAKQSLKRLRGYDDVTKDINEMRKEREEASSEQKVSIIQLFTNSSYRQPILVALMLHVAQQFSGINGIFYYSTSIFQTAGISKPVYATIGVGAVNMVFTAVSVFLVEKAGRRSLFLIGMSGMFVCAIFMSVGLVLLNKFSWMSYVSMIAIFLFVSFFEIGPGPIPWFMVAEFFSQGPRPAALAIAAFSNWTCNFIVALCFQYIADFCGPYVFFLFAGVLLAFTLFTFFKVPETKGKSFEEIAAEFQKKSGSAHRPKAAVEMKFLGATETV

SEQ ID NO: 35 - DNA, 2184 bp, Homo sapiens
ccgccttcggcccgggcctcccgggatggccgtggcgcctctgcggggggcgctgctgctgtggcagctgctggcggcgggcggcgcggcactggagatcggccgcttcgacccggagcgcgggcgcggggctgcgccgtgccaggcggtggagatccccatgtgccgcggcatcggctacaacctgacccgcatgcccaacctgctgggccacacgtcgcagggcgaggcggctgccgagctagcggagttcgcgccgctggtgcagtacggctgccacagccacctgcgcttcttcctgtgctcgctctacgcgcccatgtgcaccgaccaggtctcgacgcccattcccgcctgccggcccatgtgcgagcaggcgcgcctgcgctgcgcgcccatcatggagcagttcaacttcggctggccggactcgctcgactgcgcccggctgcccacgcgcaacgacccgcacgcgctgtgcatggaggcgcccgagaacgccacggccggccccgcggagccccacaagggcctgggcatgctgcccgtggcgccgcggcccgcgcgccctcccggagacctgggcccgggcgcgggcggcagtggcacctgcgagaaccccgagaagttccagtacgtggagaagagccgctcgtgcgcaccgcgctgcgggcccggcgtcgaggtgttctggtcccggcgcgacaaggacttcgcgctggtctggatggccgtgtggtcggcgctgtgcttcttctccaccgccttcactgtgctcaccttcttgctggagccccaccgcttccagtaccccgagcgccccatcatcttcctctccatgtgctacaacgtctactcgctggccttcctgatccgtgcggtggccggagcgcagagcgtggcctgtgaccaggaggcgggcgcgctctacgtgatccaggagggcctggagaacacgggctgcacgctggtcttcctactgctctactacttcggcatggccagctcgctctggtgggtggtcctgacgctcacctggttcctggctgccgggaagaaatggggccacgaggccatcgaggcccacggcagctatttccacatggctgcctggggcctgcccgcgctcaagaccatcgtcatcctgaccctgcgcaaggtggcgggtgatgagctgactgggctttgctacgtggccagcacggatgcagcagcgctcacgggcttcgtgctggtgcccctctctggctacctggtgctgggcagtagtttcctcctgaccggcttcgtggccctcttccacatccgcaagatcatgaagacgggcggcaccaacacagagaagctggagaagctcatggtcaagatcggggtcttctccatcctctacacggtgcccgccacctgcgtcatcgtttgctatgtctacgaacgcctcaacatggacttctggcgccttcgggccacagagcagccatgcgcagcggccgcggggcccggaggccggagggactgctcgctgccagggggctcggtgcccaccgtggcggtcttcatgctcaaaattttcatgtcactggtggtggggatcaccagcggcgtctgggtgtggagctccaagactttccagacctggcagagcctgtgctaccgcaagatagcagctggccgggcccgggccaaggcctgccgcgcccccgggagctacggacgtggcacgcactgccactataaggctcccaccgtggtcttgcacatgactaagacggacccctctttggagaaccccacacacctctagccacacaggcctggcgcggggtggctgctgccccctccttgccctccacgccctgccccctgcatcccctagagacagctgactagcagctgcccagctgtcaaggtcaggcaagtgagcaccggggactgaggatcagggcgggaccccgtgaggctcattaggggagatgggggtctcccctaatgcgggggctggaccaggctgagtccccacagggtcctagtggaggatgtggaggggcggggcagaggggtccagccggagtttatttaatgatgtaatttattgttgcgttcctctggaagctgtgactggaataaacccccgcgtggcactgctgatcctctctggctgggaagggggaaggtaggaggtgaggc

SEQ ID NO: 36 - protein, 591 aa, Homo sapiens
MAVAPLRGALLLWQLLAAGGAALEIGRFDPERGRGAAPCQAVEIPMCRGIGYNLTRMPNLLGHTSQGEAAAELAEFAPLVQYGCHSHLRFFLCSLYAPMCTDQVSTPIPACRPMCEQARLRCAPIMEQFNFGWPDSLDCARLPTRNDPHALCMEAPENATAGPAEPHKGLGMLPVAPRPARPPGDLGPGAGGSGTCENPEKFQYVEKSRSCAPRCGPGVEVFWSRRDKDFALVWMAVWSALCFFSTAFTVLTFLLEPHRFQYPERPIIFLSMCYNVYSLAFLIRAVAGAQSVACDQEAGALYVIQEGLENTGCTLVFLLLYYFGMASSLWWVVLTLTWFLAAGKKWGHEAIEAHGSYFHMAAWGLPALKTIVILTLRKVAGDELTGLCYVASTDAAALTGFVLVPLSGYLVLGSSFLLTGFVALFHIRKIMKTGGTNTEKLEKLMVKIGVFSILYTVPATCVIVCYVYERLNMDFWRLRATEQPCAAAAGPGGRRDCSLPGGSVPTVAVFMLKIFMSLVVGITSGVWVWSSKTFQTWQSLCYRKIAAGRARAKACRAPGSYGRGTHCHYKAPTVVLHMTKTDPSLENPTHL

SEQ ID NO: 37 - DNA, 2523 bp, Homo sapiens
ggatccggagggcagccttcatccacagatgctcctaaggcttggaattatgaattgcctgcaacaaattatgagacccaagactcccataaagctggacccattggcattctctttgaactagtgcatatctttctctatgtggtacagccgcgtgatttcccagaagatactttgagaaaattcttacagaaggcatatgaatccaaaattgattatgacaagattgtctactatgaagcagggattattctatgctgtgtcctggggctgctgtttattattctgatgcctctggtggggtatttcttttgtatgtgtcgttgctgtaacaaatgtggtggagaaatgcaccagcgacagaaggaaaatgggcccttcctgaggaaatgctttgcaatctccctgttggtgatttgtataataataagcattggcatcttctatggttttgtggcaaatcaccaggtaagaacccggatcaaaaggagtcggaaactggcagatagcaatttcaaggacttgcgaactctcttgaatgaaactccagagcaaatcaaatatatattggcccagtacaacactaccaaggacaaggcgttcacagatctgaacagtatcaattcagtgctaggaggcggaattcttgaccgactgagacccaacatcatccctgttcttgatgagattaagtccatggcaacagcgatcaaggagaccaaagaggcgttggagaacatgaacagcaccttgaagagcttgcaccaacaaagtacacagcttagcagcagtctgaccagcgtgaaaactagcctgcggtcatctctcaatgaccctctgtgcttggtgcatccatcaagtgaaacctgcaacagcatcagattgtctctaagccagctgaatagcaaccctgaactgaggcagcttccacccgtggatgcagaacttgacaacgttaataacgttcttaggacagatttggatggcctggtccaacagggctatcaatcccttaatgatatacctgacagagtacaacgccaaaccacgactgtcgtagcaggtatcaaaagggtcttgaattccattggttcagatatcgacaatgtaactcagcgtcttcctattcaggatatactctcagcattctctgtttatgttaataacactgaaagttacatccacagaaatttacctacattggaagagtatgattcatactggtggctgggtggcctggtcatctgctctctgctgaccctcatcgtgattttttactacctgggcttactgtgtggcgtgtgcggctatgacaggcatgccaccccgaccacccgaggctgtgtctccaacaccggaggcgtcttcctcatggttggagttggattaagtttcctcttttgctggatattgatgatcattgtggttcttacctttgtctttggtgcaaatgtggaaaaactgatctgtgaaccttacacgagcaaggaattattccgggttttggatacaccctacttactaaatgaagactgggaatactatctctctgggaagctatttaataaatcaaaaatgaagctcacttttgaacaagtttacagtgactgcaaaaaaaatagaggcacttacggcactcttcacctgcagaacagcttcaatatcagtgaacatctcaacattaatgagcatactggaagcataagcagtgaattggaaagtctgaaggtaaatcttaatatctttctgttgggtgcagcaggaagaaaaaaccttcaggattttgctgcttgtggaatagacagaatggattatgacagctacttggctcagactggtaaatcccccgcaggagtgaatcttttatcatttgcatatgatctagaagcaaaagcaaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatggattgttggagagagtaactaggactctagcttctctggattttgctcagaacttcatcacaaacaatacttcctctgttattattgaggaaactaagaagtatgggaggacaataataggatattttgaacattatctgcagtggatcgagttctctatcagtgagaaagtggcatcgtgcaaacctgtggccaccgctctagatactgctgttgatgtctttctgtgtagctacattatcgaccccttgaatttgttttggtttggcataggaaaagctactgtatttttacttccggctctaatttttgcggtaaaactggctaagtactatcgtcgaatggattcggaggacgtgtacgatgatgttgaaactatacccatgaaaaatatggaaaatggtaataatggttatcataaagatcatgtatatggtattcacaatcctgttatgacaagcccatcacaacatctcgag

SEQ ID NO: 38 - protein, 837 aa, Homo sapiens
GGQPSSTDAPKAWNYELPATNYETQDSHKAGPIGILFELVHIFLYVVQPRDFPEDTLRKFLQKAYESKIDYDKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMDYDSYLAQTGKSPAGVNLLSFAYDLEAKANSLPPGNLRNSLKRDAQTIKTIHQQRVLPIEQSLSTLYQSVKILQRTGNGLLERVTRTLASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDVETIPMKNMENGNNGYHKDHVYGIHNPVMTSPSQH

SEQ ID NO: 39 - DNA, 2363 bp, Homo sapiens
aatcaaaaccatctttattatttaaagagcatcccatcatcaggggcacctagacaggagtcccagacagcagaacaatatttacatgggggtcaggagggtgaggttgggtggtctcggggctgagtgggcccgccactgtggaagagaggaccctggagggagggtgtccttggacctgtggaccgggcccaagaagaaaaacgtcccatcctcggcccagcgtggatcccaccaccgggatcacctcgggccctggaggctgcgcagcgagaagccaccggtcagagctgggtcaccatgccgctggcttcggagtgagtctttatggcctggaagatccactcccggaagtcactgactttggtgtagacgcctggcttctgggccagggcacagccagtgccccaactcacaatgccacacagccgccaacgtggcgtccgagagatgctgtcctcacacacaaagggaccaccgctgtcgccctggcaggcatcaatgccaccctcggggtagccagcacagaacatcttgggcttgatctggtttccatagaagtcagcgccattgcagacatcattgctgattatggggactcgagcctcctggagtaccccggcctgttggccatagtactgcgtgttgccccagcccgtcacggtacagatcttgccatccaccagggcctggccggcagctgggaggcacacaggctggatgtattctgtgaggggcaggggactggagaggtggaccagggcaatatcgttgctgttctcctcgctgttggggtcccgaaagggaagatagcccccgtggtagaccacagcctgcacccccagctgcagaccgtggggagaggcctgggccacggcaccggcaaacactcgccatcgggacaggacccggttccgctccgggaagcagtgggcggctgtcagcacccagtccccggagagcagggatcccccacagaggtgtgctccatcatagcgaaggctgacttgccacggccaccggcccaagctggtgtcccggcctcccacgatgcggtccacgggcagcttcctgcggccacagtcttggcagatggcggccaagaaacggcctctggggcaatcacacacggagatgacctccagcagcctctgggtgtggggcagcctcccctcgtccacacagaagaagcccgacgtgccattggcgcccgccgttcgcacgtccagctcggagtgggtcagtgccctgaggaagcccatctcctcgcagctgagtccggctaccctggcgttggagcgcgaggagcacagcagccgccacgtcccttccgtcttgtcaaagaccatgagccgagcgtccgcagagctgacctgcactgggtacagcggctcctggtcactcctgaggagaacagccacaatggcccaggatgccgccccgatggctgtcagaagtagcagggtccccgcagtgagagctgccaccttgggtctggagcagcatggcacagtccggccaccctccttctgcgccatgtcactgcctcttgttaatgattccctggctgacctcctgggccagggtgggacctgtgaggagatggacggggaggcagggcctgggggagcccagcccagcccagtcctggcgcccccagtcccaggcgtccatccaggcaggctgtagggactgggccttggccagagcacgccgtgatcacggacgcagattgggctgggttcaaggatggggtcagtgtctgaccagcagcggggggacgcctggatttgcagggatggggacccccatgcctgagcctggtggagcaggggactgaggatcccggtttgagggaggagacagctgaggacctgaaatcataagtcttgggaaaggaggaatttgggggccaggactccctagtatgagggaggaggggcctgagggctggaactcctgggtctggggaggaaaggactggggtccaacggctgagtctgaaggaagagcaggacagaacacctaggtgcttggggagacgtcatagtgccccctcttcaggtccccaggaacccctctattaggaggtgggcattaggctgggtggggggatgagggaacccctgtcctcagggctggaactgtgagtctgggggcccttgtccttaccctggggtccagcaggtgggggcggagcctcgaggtagtgccggggtcgggtcagtctccaggcctgggcaggagcatggtggccccgcagcagcgggcggcctggaggcagaggcggtggcgtggggcctgctaggccaggctgcctcacctgtgggccctcaggtagggtccctggaaagcgggctcga

SEQ ID NO: 40 - protein, 417 aa, Homo sapiens
MAQKEGGRTVPCCSRPKVAALTAGTLLLLTAIGAASWAIVAVLLRSDQEPLYPVQVSSADARLMVFDKTEGTWRLLCSSRSNARVAGLSCEEMGFLRALTHSELDVRTAGANGTSGFFCVDEGRLPHTQRLLEVISVCDCPRGRFLAAICQDCGRRKLPVDRIVGGRDTSLGRWPWQVSLRYDGAHLCGGSLLSGDWVLTAAHCFPERNRVLSRWRVFAGAVAQASPHGLQLGVQAVVYHGGYLPFRDPNSEENSNDIALVHLSSPLPLTEYIQPVCLPAAGQALVDGKICTVTGWGNTQYYGQQAGVLQEARVPIISNDVCNGADFYGNQIKPKMFCAGYPEGGIDACQGDSGGPFVCEDSISRTPRWRLCGIVSWGTGCALAQKPGVYTKVSDFREWIFQAIKTHSEASGMVTQL

SEQ ID NO: 41 - protein, 381 aa, Homo sapiens; identical to SEQ ID NO: 2

SEQ ID NO: 42 - protein, 381 aa, Homo sapiens [sequence omitted]

SEQ ID NO: 43 - protein, 381 aa, Homo sapiens [sequence omitted]

SEQ ID NO: 44 - protein, 381 aa, Homo sapiens [sequence omitted]

SEQ ID NO: 45 - protein, 379 aa, Mus musculus
MSSSTFRTLAVAVTLLHLTRLALSTCPAACHCPLEAPKCAPGVGLVRDGCGCCKVCAKQLNEDCSKTQPCDHTKGLECNFGASSTALKGICRAQSEGRPCEYNSRIYQNGESFQPNCKHQCTCIDGAVGCIPLCPQELSLPNLGCPNPRLVKVSGQCCEEWVCDEDSIKDSLDDQDDLLGLDASEVELTRNNELIAIGKGSSLKRLPVFGTEPRVLFNPLHAHGQKCIVQTTSWSQCSKSCGTGISTRVTNDNPECRLVKETRICEVRPCGQPVYSSLKKGKKCSKTKKSPEPVRFTYAGCSSVKKYRPKYCGSCVDGRCCTPLQTRTVKMRFRCEDGEMFSKNVMMIQSCKCNYNCPHPNEASFRLYSLFNDIHKFRD

SEQ ID NO: 46 - protein, 628 aa, Homo sapiens; identical to SEQ ID NO: 4

SEQ ID NO: 47 - protein, 630 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQAPRRPLPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 48 - protein, 622 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSVQEALSGTPCLLGPGPVLTVLALLLASTLA

SEQ ID NO: 49 - protein, 622 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 50 - protein, 622 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAPEIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 51 - protein, 114 aa, Homo sapiens; identical to SEQ ID NO: 6

SEQ ID NO: 52 - protein, 114 aa, Homo sapiens [sequence omitted]

SEQ ID NO: 53 - protein, 114 aa, Mus musculus
MLAFSLLVLGLLAEVAPASCQQGLGNLQPWMQGLIAVAVFLVLVAIVFAVNHFWCQEEPEPGSTVMIIGNKADGVLVGMDGRYSSMASGFRSSEHKNAYENVLEEEGRVRSTPM

SEQ ID NO: 54 - protein, 114 aa, Rattus norvegicus
MLALSLLALGLLAEVAPASCQQGLGNLQPWMQGLIAVAVFLVLVAIAFAVNHFWCQEEQEPGSTMMITGNKADGVLVGMDGRYSSMASGFRSSEHKNAFENVLEEEGRVRSTPM

SEQ ID NO: 55 - protein, 78 aa, Rattus norvegicus
ISYKHSRPPAAPGVKTPAVLQLPAAMLALILLALGLLAEVAPASCLQGLGNLQPWMLGLIAVAVFLVLVAIAFPVNRF

SEQ ID NO: 56 - protein, 159 aa, Homo sapiens
MTALTEEAAVTVTPPITAQQADNIEGPIALKFSHLCLEDHNSYCINGACAFHHELEKAICRCFTGYTGERCEHLTLTSYAVDSYEKYIAIGIGVGLLLSGFLVIFYCYIRKRCLKLKSPYNVCSGERRPLYQWNYLVTIHLDRNPGSLLLNKSLQLALK

SEQ ID NO: 57 - protein, 152 aa, Mus musculus
MALGVLIAVCLLFKAMKAALSEEAEVIPPSTAQQSNWTFNNTEADYIEEPVALKFSHPCLEDHNSYCINGACAFHHELKQAICRCFTGYTGQRCEHLTLTSYAVDSYEKYIAIGIGVGLLISAFLAVFYCYIRKRCINLKSPYIICSGGSPL

SEQ ID NO: 58 - protein, 354 aa, Mus musculus
YPQDSARVAFCLPGSRASNQPAGGGGDCPGGRGKSNCSELNLRESDIRVCDESSCKYGGVCKEDGDGLKCACQFQCHTNYIPVCGSNGDTYQNECFLRRAACKHQKDITVVARGPCYSDNGSGSGEGAEEEGSGAGAHRKHSKCGPCKYKAECDEDAENVGCVCNIDCSGYSFNPVCASDGSSYNNPCFVREASCIKQEQIDIRHLGHCTDTDDVSSLGKKDPGLLYRPDVKDAGDEREDVYIGSHMPCPENLNGYCIHGKCEFIYSTQKASCRCESGYTGQHCEKTDFSILYVVPSRQKLTHVLIAAIIGAVQIAIIVAIVMCITRKCPKNNRGRRQKQNLGHFTSDTSSKMV

SEQ ID NO: 59 - protein, 373 aa, Rattus norvegicus
MGAQAPLRLPAAPPLAVCGYTSVLLLFAFCLPGSGASNQPAGGGGDCPGGRGKSINCSELNLRESDIRACDESSCKYGGVCKEDGDGLKCACQFQCHTNYIPVCGSNGDTYQNECFLRRAACKHQKDITVVARGPCYSDNGSGSGEGEEEGSGAGAHRKHSKCGPCKYKAECDEDAENVGCVCNIDCSGYSFNPVCASDGSSYNNPCFVREASCIRQEQIDIRHLGHCTDTDDTSLLGKKDDGLQYRPDVKDAGDQREDVYIGSHMPCPENLNGYCIHGKCEFIYSTQKASCRCESGYTGQHCEKTDFSILYVVPSRQKLTHVLIAAIIGAVQIAIIVAIVMCITRKCPKNNRGRRQKQNLGHFTSETSSRMV

SEQ ID NO: 60 - protein, 380 aa, Homo sapiens
MGAAAAEAPLRLPAAPPLAFCCYTSVLLLFAFSLPGSRASNQPPGGGGGSGGDCPGGKGKSINCSELNVRESDVRVCDESSCKYGGVCKEDGDGLKCACQFQCHTNYIPVCGSNGDTYQNECFLRRAACKHQKEITVIARGPCYSDNGSGSGEGEEEGSGAEVHRKHSKCGPCKYKAECDEDAENVGCVCNIDCSGYSFNPVCASDGSSYNNPCFVREASCIKQEQIDIRHLGHCTDTDDTSLLGKKDDGLQYRPDVKDASDQREDVYIGNHMPCPENLNGYCIHGKCEFIYSTQKASCRCESGYTGQHCEKTDFSILYVVPSRQKLTHVLIAAIIGAVQIAIIVAIVMCITRKCPKNNRGRRQKQNLGHFTSDTSSRMV

SEQ ID NO: 61 - protein, 81 aa, Homo sapiens; identical to SEQ ID NO: 10

SEQ ID NO: 62 - protein, 81 aa, Mus musculus
MAAVAAASAELLIIGWYIFRVLLQVFLECCIYWVGFAFRNPPGTQPIARSEVFRYSLQKLAHTVSRTGRQVLGERRQRAPN

SEQ ID NO: 63 - protein, 81 aa, Rattus norvegicus
MAAVAAASAELLIIGWYIFRVLLQVFLECCIYWVGFAFRNPPGTQPIARSEVFRYSLQKLAHTVSRTGRQVLGERRHRAPN

SEQ ID NO: 64 - protein, 208 aa, Mus musculus
MAAVAAASAELLIIGWYIFRVLLQVFLECCIYWVGFAFRNPPGTQPIARSEVFRYSLQKLAHTVSRTGRQVLGERSSEPPTEAPAPSPGRPCHQVLLCFSTAWEPVPRRNGGSLCLLVRVALAKVSEGPVAPRKAAPTMMKISVPFPAPLPLSHYRRVGEEGGRGEQPSRYGRRHHILIWTKSEQYHLSRTRSYHEDRTAHQPAEWTF

SEQ ID NO: 65 - protein, 55 aa, Mus musculus
MVPKVAAASAELLIIGWYIFRVLLQVFRYSLQKLAHTVSRTGRQVLGERRQRAPN

SEQ ID NO: 66 - protein, 394 aa, Homo sapiens [sequence omitted]

SEQ ID NO: 67 - protein, 394 aa, Homo sapiens
MAMAYLAWRLARRSCPSSLQVTSFPVVQLHMNRTAMRASQKDFENSMNQVKLLKKDPGNEVKLKLYALYKQATEGPCNMPKPGVFDLINKAKWDAWNALGSLPKEAARQNYVDLVSSLSPSLESSSQVEPGTDRKSTGFETLVVTSEDGITKIMFNRPKKKNAINTEMYHEIMRALKAASKDDSIITVLTGNGDYYSSGNDLTNFTDIPPGGVEEKAKNNAVLLREFVGCFIDFPKPLIAVVNGPAVGISVTLLGLFDAVYASDRATFHTPFSHLGQSPEGCSSYTFPKIMSPAKATEMLIFGKKLTAGEACAQGLVTEVFPDSTFQKEVWTRLKAFAKLPPNALRISKEVIRKREREKLHAVNAEECNVLQGRWLSDECTNAVVNFLSRKSKL

SEQ ID NO: 68 - protein, 374 aa, Homo sapiens
VTSFPVVQLHMNRTAMRASQKDFENSMNQVKLLKKDPGNEVKLKLYALYKQATEGPCNMPKPGVFDLINKAKWDAWNALGSLPKEAARQNYVDLVSSLSPSLESSSQVEPGTDRKSTGFETLVVTSEDGITKIMFNRPKKKNAINTEMYHEIMRALKAASKDDSIITVLTGNGDYYSSGNDLTNFTDIPPGGVEEKAKNNAVLLREFVGCFIDFPKPLIAVVNGPAVGISVTLLGLFDAVYASDRATFHTPFSHLGQSPEGCSSYTFPKIMSPAKATEMLIFGKKLTAGEACAQGLVTEVFPDSTFQKEVWTRLKAFAKLPPNALRISKEVIRKREREKLHAVNAEECNVLQGRWLSDECTNAVVNFLSRKSKL

SEQ ID NO: 69 - protein, 348 aa, Homo sapiens
MLLSILVALCLWLRLALGVRGAPCEAVRIPMCRHMPWNITRMPNHLHHSTQENAILAIGQYEELVDVNCSSVLSFFLCAMYAPICTLEFLHDPIKPCKSVCQRARDDCEPLMKMYNHSWPESLACDELPVYDRGVCISPEAIVTDLPEDVKWIDITPDMMVQERSFDADCKHLSPDRCKCKKVKPTLATYLSKNYSYVIHAKIKAVQRSGCNEVTTVVDVKEIFKSSSPIPRTQVPLITNSSCQCPHILPHQDVLIMCYERRSRMMLLENCLVEKWRDQLSRRSTQWEERLQEQQRTTQDKKQIASRTSRSNPPKPKGRSPASKPASPKKNIKARSAPKKSNPKKSTS

SEQ ID NO: 70 - protein, 364 aa, Homo sapiens [sequence omitted]

SEQ ID NO: 71 - protein, 966 aa, Mus musculus
MAKGFYISKTLGILGILLGVAAVCTIIALSVVYAQEKNRNAENSATAPTLPGSTSATTATTTPAVDESKPWNQYRLPKTLIPDAYRVILRPYLTPNNQGLYIFQGNSTVRFTCNQTTDVIIIHSKKLNYTLKGNHRVVLRTLDGTPAPNIDKTELVERTEYLVVHLQGSLVEGRQYEMDSQFQGELADDLAGFYRSEYMEGDVKKVVATTQMQAADARKSFPCFDEPAMKAMFNITLIYPNNLIALSNMLPKESKPYPEDPSCTMTEFHSTPKMSTYLLAYIVSEFKNISSVSANGVQIGIWARPSAIDEGQGDYALNVTGPILNFFAQHYNTSYPLPKSDQIALPDFNAGAMENWGLVTYRESSLVFDSQSSSISNKERVVTVIAHELAHQWFGNLVTVAWWNDLWLNEGFASYVEYLGADYAEPTWNLKDLMVLNDVYRVMAVDALASSHPLSSPADEIKTPDQIMELFDSITYSKGASVIRMLSSFLTEDLFKKGLSSYLHTYQYSNTVYLDLWEHLQKAVNQQTAVQPPATVRTIMDRWILQMGFPVITVNTNTGEISQKHFLLDSKSNVTRPSEFNYIWIAPIPFLKSGQEDHYWLDVEKNQSAKFQTSSNEWILLNINVTGYYLVNYDENNWKKLQNQLQTDLSVIPVINRAQIIHDSFNLASAKMIPITLALDNTLFLVKEAEYMPWQAALSSLNYFTLMFDRSEVYGPMKRYLKKQVTPLFFYFQNRTNNWVNRPPTLMEQYNEINAISTACSSGLKECRDLVVELYSQWMKNPNNNTIHPNLRSTVYCNAIAFGGEEEWNFAWEQFRNATLVNEADKLRSALACSKDVWILNRYLSYTLNPDYIRKQDTTSTIISIASNVAGHPLVWDFVRSNWKKLFENYGGGSFSFANLIQGVTRRFSSEFELQQLEQFKADNSATGFGTGTRALEQALEKTRANIDWVKENKDAVFKWFTENSS

SEQ ID NO: 72 - protein, 966 aa, Orycctolagus cuniculus
MAKGFYISKSLGILGILLGVAALCTIVALSVVYRQEKNKNTSQSPSMAPLNPTATSSPATTLDQNLPWNRYRLPKTLIPDSYNVVLRPYLSPNSQGLYIFTGSSTVRFTCQEATNVIIIHSKKLNYTITQGHRVVLRGVRGSQPPAIASTELVELTEYLVVHLQGQLVAGSQYEMDTQFQGELADDLAGFYRSEYMEGNVRKVVATTQMQAADARKSFPCFDEPAMKATFNITPIHPRDYTALSNMLPRSSTALPEDPNWTVTEFHTTPKMSTYLLAYIVSEFTNIEAQSPNNVQIRIWARPSAISEGHGQYALNVTGPILNFFANHYNTPYPLEKSDQIGLPDFNAGAMENWGLVTYRESALLFDPLVSSISNKERVVTVVAHELAHQWFGNLVTVDWWNDLWLNEGFASYVEYLGADYAEPTWNLKDLIVLNELHSVMAVDALASSHPLSSPADEVNTPAQISELFDSITYSKGASVLRMLSSFLTEDLFKEGLASYLHTFAYQNTIYLDLWEHLQQAVNSQSAIQLPASVRDIMDRWILQMGFPVVTVNTTNGIISQHHFLLDPTSNVTRPSDFNYLWIVPVSSMRNGVLEQEFWLEGVEQTQNSLFRVEGDNNWILANLNVTGYYQVNYDEGNWKKLQTQLQTNPSVIPVINRAQIIHDAFNLASAQKVPVTLALDNTLFLIRETEYMPWQAALSSLNYFKLMFDRSEVYGPMKNYLSKQVRPLFEHFKNITNDWTRRPDTLMDQYNEINAISTACSNGIQECETLVSDLFKQWMDDPSNNPIHPNLRTTVYCNAIALGGEREWDFAWEQFRNATLVNEADKLRSALACSNEVWILNRYLSYTLNPDYIRRQDATSTINSIASNVIGQTLVWDFVQSNWKKLFEDFGGGSFSFANLIRAVTRRFSTEYELQQLEQFRLNNLDTGFGSGTRALEQALEQTRANIKWVQENKEAVLAWFTANSA

SEQ ID NO: 73 - protein, 974 aa, Mus musculus
MAKGFYISKTLGILGILLGVAAVCTIIALSVVYAQEKNRNAENSATAPTLPGSTSATTATTTATTTATTTPAVDESKPWNQYRLPKTLIPDSYRVILRPYLTPNNQGLYIFQGSSTVRFTCNQTTDVIIIHSKKLNYTLKGNHRVVLRTLDGTPAPNIDKTELVERTEYLVVHLQGSLVEGRQYEMDSEFQGELADDLAGFYRSEYMEGGVKKVVATTQMQAADARKSFPCFDEPAMKAMFNITLIYPNNLIALSNMLPKESKPYPEDPSCTMTEFHSTPKMSTYLLAYIVSEFKNISSVSANGVQIGIWARPSAIDEGQGDYALNVTGPILNFFAQHYNTSYPLPKSDQIALPDFNAGAMENWGLVTYRESSLVFDSQSSSISNKERVVTVIAHELAHQWFGNLVTVAWWNDLWLNEGFASYVEYLGADYAEPTWNLKDLMVLNDVYRVMAVDALASSHPLSSPADEIKTPDQIMELFDSITYSKGASVIRMLSSFLTEDLFKKGLSSYLHTYQYSNTVYLDLWEHLQKAVNQQTAVQLPATVRTIMDRWILQMGFPVITVNTSTGEISQKHFLLDSKSNVTRPSEFNYIWIAPIPFLKSGQEDHYWLDVEKNQSAKFQTSSNEWILLNINVTGYYLVNYDENNWKKLQNQLQTDLSVIPVINRAQIIHDSFNLASAKMIPITLALDNTLFLVKETEYMPWQAALSSLNYFTLMFDRSEVYGPMKRYLKKQVMPLFFYFQNRTNNWVNRPPTLMEQYNEINAISTACSSGLKECRDLVVELYSQWMKNPNNNTIHPNLRSTVYCNAIAFGGEEEWNFAWEQFRNATLVNEADKLRSALACSKDVWILNRYLSYTLNPDYIRKQDTTSTIISIASNVAGHPLVWDFVRSNWKKLFENYGGGSFSFANLIQGVTRRFSSEFELQQLEQFKADNSATGFGTGTRALEQALEKTRANIDWVKENKDAVFKWFTENSG

SEQ ID NO: 74 - protein, 967 aa, Homo sapiens
MAKGFYISKSLGILGILLGVAAVCTIIALSVVYSQEKNKNANSSPVASTTPSASATTNPASATTLDQSKAWNRYRLPNTLKPDSYQVTLRPYLTPNDRGLYVFKGSSTVRFTCKEATDVIIIHSKKLNYTLSQGHRVVLRGVGGSQPPDIDKTELVEPTEYLVVHLKGSLVKDSQYEMDSEFEGELADDLAGFYRSEYMEGNVRKVVATTQMQAADARKSFPCFDEPAMKAEFNITLIHPKDLTALSNMLPKGPSTPLPEDPNWNVTEFHTTPKMSTYLLAFIVSEFDYVEKQASNGVLIRIWARPSAIAAGHGDYALNVTGPILNFFAGHYDTPYPLPKSDQIGLPDFNAGAMENWGLVTYRENSLLFDPLSSSSSNKERVVTVIAHELAHQWFGNLVTIEWWNDLWLNEGFASYVEYLGADYAEPTWNLKDLMVLNDVYRVMAVDALASSHPLSTPASEINTPAQISELFDAISYSKGASVLRMLSSFLSEDVFKQGLASYLHTFAYQNTIYLNLWDHLQEAVNNRSIQLPTTVRDIMNRWTLQMGFPVITVDTSTGTLSQEHFLLDPDSNVTRPSEFNYVWIVPITSIRDGRQQQDYWLIDVRAQNDLFSTSGNEWVLLNLNVTGYYRVNYDEENWRKIQTQLQRDHSAIPVINRAQIINDAFNLASAHKVPVTLALNNTLFLIEERQYMPWEAALSSLSYFKLMFDRSEVYGPMKNYLKKQVTPLFIHFRNNTNNWREIPENLMDQYSEVNAISTACSNGVPECEEMVSGLFKQWMENPNNNPIHPNLRSTVYCNAIAQGGEEEWDFAWEQFRNATLVNEADKLRAALACSKELWILNRYLSYTLNPDLIRKQDATSTIISITNNVIGQGLVWDFVQSNWKKLFNDYGGGSFSFSNLIQAVTRRFSTEYELQQLEQFKKDNEETGFGSGTRALEQALEKTKANIKWVKENKEVVLQWFTENSK

SEQ ID NO: 75 - protein, 967 aa, Homo sapiens [sequence omitted]

SEQ ID NO: 76 - protein, 74 aa, Homo sapiens; identical to SEQ ID NO: 16

SEQ ID NO: 77 - protein, 61 aa, Homo sapiens
AEEYVGLSANQCAVPAKDRVDCGYPHVTPKECNNRGCCFDSRIPGVPWCFKPLTRKTECTF

SEQ ID NO: 78 - protein, 73 aa, Homo sapiens
MLGLVLALLSSSSAEEYVGLSANQCAVPAKDRVDCGYPHVTPKECNNRGCCFDSRIPGVPWCFKPLQEAECTF

SEQ ID NO: 79 - protein, 80 aa, Homo sapiens
MAARALCMLGLVLALLSSSSAEEYVGLSANQCAVPAKDRVDCGYPHVTPKECNNRGCCFDSRIPGVPWCFKPLQEAECTF

SEQ ID NO: 80 - protein, 59 aa, Homo sapiens
  VARIANT (1): Where Xaa is any amino acid as defined in the specification
XEYVGLSANQCAVPAKDRVDCGYPHVTPKECNNRGCCFDSRIPGVPWCFKPLQEAECTF

SEQ ID NO: 81 - protein, 313 aa, Homo sapiens; identical to SEQ ID NO: 18

SEQ ID NO: 82 - protein, 303 aa, Homo sapiens
MPEESSPRRTPQSIPYQDLPHLVNADGQYLFCRYWKPTGTPKALIFVSHGAGEHSGRYEELARMLMGLDLLVFAHDHVGHGQSEGERMVVSDFHVFVRDVLQHVDSMQKDYPGLPVFLLGHSMGGAIAILTAAERPGHFAGMVLISPLVLANPESATTFKVLAAKVLNLVLPNLSLGPIDSSVLSRNKTEVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 83 - protein, 303 aa, Mus musculus
MPEASSPRRTPQNVPYQDLPHLVNADGQYLFCRYWKPSGTPKALIFVSHGAGEHCGRYDELAHMLKGLDMLVFAHDHVGHGQSEGERMVVSDFQVFVRDVLQHVDTIQKDYPDVPIFLLGHSMGGAISILVAAERPTYFSGMVLISPLVLANPESASTLKVLAAKLLNFVLPNMTLGRIDSSVLSRNKSEVDLYNSDPLVCRAGLKVCFGIQLLNAVARVERAMPRLTLPFLLLQGSADRLCDSKGAYLLMESSRSQDKTLKMYEGAYHVLHRELPEVTNSVLHEVNSWVSHRIAAAGAGCPP

SEQ ID NO: 84 - protein, 277 aa, Ectromelia virus
MSANCMFNLDNDYIYCKYWKPITYPKALVFISHGAGEHSGRYDELAENISSLGILVFSHDHIGHGRSNGEKMMIDDFGTYVRDVVQHVVTIKSTYPGVPVFLLGHSMGATISILAAYENPNLFTAMILMSPLVNADAVPRLNLLAAKLMGTITPNVSVGKLCPESVSRDKDEVYKYQYDPLVNHEKIKAGFASQVLKATNKVRKIIPKINTPTLILQGTNNEISDVSGAYYFMQHANCNREIKIYEGAKHHLHKETDEVKKSVMKEIETWIFNRVKL

SEQ ID NO: 85 - protein, 276 aa, Monkeypox virus
MSANCMFNLDNDYIYCKYWKPITYPKALVFISHGAGEHSGRYDELAENISSLGILVFSHDHIGHGRSNGEKMMIDDFGKYVRDVVQHVVTIKSTYPGVPVFLLGHSMGATISILAACDNPNLFTAMILMSPLVNADAVPRLNLLAAKLMGTITPNASVGKLCPESVSRDMDEVYKYQYDPLVNHEKIKAGFASQVLKATNKVRKIIPKIDTPTLILQGTNNEISDVSGAYYFMQHANCNREIKIYEGAKHHLHKETDEVKKSVMKEIETWIFNRVK

SEQ ID NO: 86 - protein, 312 aa, Homo sapiens; identical to SEQ ID NO: 20

SEQ ID NO: 87 - protein, 294 aa, Homo sapiens
MRMLLALLALSAARPSASAVPVKWGGNCQKDRQSPINIVTTKAKVDKKLGRFFFSGYDKKQTWTVQNNGHSVMMLLENKASISGGGLPAPYQAKQLHLHWSDLPYKGSEHSLDGEHFAMEMHIVHEKEKGTSRNVKEAQDPEDEIAVLAFLVEAGTQVNEGFQPLVEALSNIPKPEMSTTMAESSLLDLLPKEEKLRHYFRYLGSLTTPTCDEKVVWTVFREPIQLHREQILAFSQKLYYDKEQTVSMKDNVRPLQQLGQRTVIKSGAPGRPLPWALPALLGPMLACLLAGFLR

SEQ ID NO: 88 - protein, 266 aa, Homo sapiens
AESHWCYEVQAESSNYPCLVPVKWGGNCQKDRQSPINIVTTKAKVDKKLGRFFFSGYDKKQTWTVQNNGHSVMMLLENKASISGGGLPAPYQAKQLHLHWSDLPYKGSEHSLDGEHFAMEMHIVHEKEKGTSRNVKEAQDPEDEIAVLAFLVEAGTQVNEGFQPLVEALSNIPKPEMSTTMAESSLLDLLPKEEKLRHYFRYLGSLTTPTCDEKVVWTVFREPIQLHREQILAFSQKLYYDKEQTVSMKDNVRPLQQLGQRTVIKS

SEQ ID NO: 89 - protein, 262 aa, Homo sapiens
AESHWCYEVQAESSNYPCLVPVKWGGNCQKDRQSPINIVTTKAKVDKKLGRFFFSGYDKKQTWTVQNNGHSVMMLLENKASISGGGLPAPYQAKQLHLHWSDLPYKGSEHSLDGEHFAMEMHIVHEKEKGTSRNVKEAQDPEDEIAVLAFLVEAGTQVNEGFQPLVEALSNIPKPEMSTTSSLLDLLPKEEKLRHYFRYLGSLTTPTCDEKVVWTVFREPIQLHREQILAFSQKLYYDKEQTVSMKDNVRPLQQLGQRTVIK

SEQ ID NO: 90 - protein, 335 aa, Homo sapiens
  VARIANT (8): Where Xaa is any amino acid as defined in the specification
  VARIANT (235): Where Xaa is any amino acid as defined in the specification
MRMLLALXALSPARPSASAESHWCYEVQAESSNYPCLVPVKWGGNCQKDRQSPINIVTTKAKVDKKLGRFFFSGYDKKQTWTVQNNGHSVMMLLENKASISGGGLPAPYQAKQLHLHWSDLPYKGSEHSLDGEHFAMEMHIVHEKEKGTSRNVKEAQDPEDEIAVLAFLVEAGTQVNEGFQPLVEALSNIPKPEMSTTMAESSLLDLLPKEEKLRHYFRYLGSLTTPTCDEKVVXDCVPGAHSASQRTDPGILSEAVLRQGTDSEHEGQCQAPAAAGAAHGDKVRGPGSAAALGPACPAGPPCWPACWPASCNDASLLHAPSLLPQLSKFQASGP

SEQ ID NO: 91 - protein, 581 aa, Homo sapiens; identical to SEQ ID NO: 22

SEQ ID NO: 92 - protein, 585 aa, Gallus gallus
MGPAAGNLVRAVLALCWLAEHCAGISSIDIERPGDGRCQPIEIPMCKDIGYNMTRMPNLMGHENQREAAIQLHEFAPLVEYGCHGHLKFFLCSLYAPMCTEQVSTPIPACRVMCEQARLKCSPIMEQFNFKWPDSLDCSKLPNKNDPNYLCMEAPNNGSDEPPRGSSMLPPMFRPQRPSTGHDLQQHKDSLSRTSCENPGKFHHVEKSASCAPLCTPGVDVYWSKDDKQFAVIWIAIWSILCFFSSAFTVLTFLIDPQRFKYPERPIIFLSMCYCVYSVGYIIRLFSGAESIACDRDSGQLYVIQEGLESTGCTIVFLVLYYFGMASSLWWVILTLTWFLAAGKKWGHEAIEANSSYFHLAAWAIPAVKTIMILVMRRVAGDELTGLCYVGSMDVNALTGFVLIPLACYLIIGTSFILSGFVALFHIRRVMKTGGENTDKLEKLMVRIGVFSVLYTVPATCVIACYFYERLNMDYWKIVASQQKCKMNNQTKNLDCMMNNSIPAVEIFMVKIFMLLVVGITSGMWIWTSKTLQSWQNVCSRRLKKRSRRKPASVITSSGIYKKPQHPQKTHLAKYESTLQPPTCV

SEQ ID NO: 93 - protein, 586 aa, Xenopus laevis
MDVSGVTGLLRGTALLLVLAAALCSAISSINPDRSGDGRCQAIEIPMCKDIGYNMTRMPNLMGHENQKEAAIQLHEFAPLVEYGCHSHLKFFLCSLYAPMCTEQVSTPIPACRVMCEQARLKCSPIMEQFNFKWPDSLDCSKLPNKNDPNYLCMEAPNNGTDETPRGSSMLPPIFRPQRPSSGHEIYPKDPTSRSSCENSGKFHHVEKSASCAPLCSSSVDVYWSKDDKKFAFIWIAIWSILCFFSSAFTVLTFLVDPLRFKYPERPIIFLSMCYCVYSVGYIIRLFAGADSIACDRDSGQLYVIQEGLESTGCTIVFLILYYFGMASSLWWVILTLTWFLAAGKKWGHEAIEANSSYFHLAAWAIPAVKTIMILVMRRVAGDELTGVCYVGSMDVNALTGFVLIPLACYLIIGTSFILSGFVALFHIRRVMKTGGENTDKLEKLMVRIGVFSVLYTVPATCVIACYFYERLNMDFWKILATQDKCKMDSQTKTLDCTMTSSIPAVEIFMVKIFMLLVVGITSGMWIWTSKTVQSWQNVFSKRLKKRNRSKPASVITSAGIYKKPQHPPKVHHGKYESALQSPTCV

SEQ ID NO: 94 - protein, 530 aa, Xenopus laevis
MEPRVVTALLLSLAAALCSGISSINPDRSGEGRCQAIEIPMCKDIGYNMTRMPNLMGHENQKEAAIQLHEFAPLVEYGCHSHLKFFLCSLYAPMCTEQVSTPIPACRVMCEQARLKCSPIMEQFNFKWPDSLDCSKLPNKNDPNYLCMEAPNNGTDEAPRSSSILPPIFRPQRPNSGHEMYPKDPKGRSSCENSGKFHHVEKSASCAPLCSSSVDVYWSKNDKKFAFIWIAIWSLLCFFSSAFTVLTFLVDPLRFKYPERPIIFLSMCYCVYSVGYIIRLFAGADSIACDRDSGQLYVIQEGLESTGCTIVFLILYYFGMASSLWWVILTLTWFLAAGKKWGHEAIEANSSYFHLAAWAIPAVKTIMILVMRRVAGDELTGVCYVGSMDVNALTGFVLIPLACYLIIGTSFILSGFVALFHIRRVMKTGGENTDKLEKLMVRIGVFSVLYTVPATCVIACYFYERLNMDFWKILATQDKCKMDSQTKTLDCTMNKPASVITSAGIYKKPQQPPKIHHGKYESALRSPTCV

SEQ ID NO: 95 - protein, 580 aa, Danio rerio
MFAAGVGISLGLLCFAGFCSAISSIDPDRPGEGRCQEIAIPLCKDIGYNLTVMPNLMGHEDQNEAAIKLHEFAPLIEFGCHSHLKFFLCSLYAPMCTEQVSTPIPACRVMCEQARQKCSPIMEQFNFHWPESLDCSRLPNKNDPNYLCMEAPNNGTDEPPKGSHTQSPDSRPPRPGNSQELPIKERVGKTTCSNPGKFHYVQKSESCAPKCYSNVDVYWSQGDKRFSMVWIAIWSILCFISSAFTVLTFLIDPQRFKYPERPIIFLSMSYCVYSVGFLVRLFVGVENVACDRDTGVQYIIQEGLESTGCTIVFLILYYFGMASSLWWVILTLTWFLAAGKKWGHEAIEANSSYFHLAAWAIPAIKTIMILVMRKVAGDELTGVCYVGSMDVKALTGFVLIPLSCYLIIGTSFLLSGFVALFHIRKVMKTEGENTDKLEKLMVRIGVFSVLYTVPATCVIACYFYERLNMDYWKILAGEQKCADDGKSGEECVMKSSIPAVEIFMVKIFMLLVVGITSGMWIWTSKTLQSWQNVFSRKLKKKTRRKAACVFTGSGPYLKPHPALKGHKTKYEPAGPPATCV

SEQ ID NO: 96 - protein, 346 aa, Homo sapiens; identical to SEQ ID NO: 24

SEQ ID NO: 97 - protein, 346 aa, Homo sapiens
MFLSILVALCLWLHLALGVRGAPCEAVRIPMCRHMPWNITRMPNHLHHSTQENAILAIEQYEELVDVNCSAVLRFFLCAMYAPICTLEFLHDPIKPCKSVCQRARDDCEPLMKMYNHSWPESLACDELPVYDRGVCISPEAIVTDLPEDVKWIDITPDMMVQERPLDVDCKRLSPDRCKCKKVKPTLATYLSKNYSYVIHAKIKAVQRSGCNEVTTVVDVKEIFKSSSPIPRTQVPLITNSSCQCPHILPHQDVLIMCYEWRSRMMLLENCLVEKWRDQLSKRSIQWEERLQEQRRTVQDKKKTAGRTSRSNPPKPKGKPPAPKPASPKKNIKTRSAQKRTNPKRV

SEQ ID NO: 98 - protein, 348 aa, Rattus norvegicus; identical to SEQ ID NO: 69

SEQ ID NO: 99 - protein, 348 aa, Rattus norvegicus
  VARIANT (251): Where Xaa is any amino acid as defined in the specification
MLLSILVALCLCVRLALGVRGAPCEAVRIPMCRHMPWNITRMPNHLHHSTQENAILAIEQYEELVDVNCSSVLRFFLCAMYAPICTLEFLHDPIKPCKSVCQRARDDCEPLMKMYNHSWPESLACDELPVYDRGVCISPEAIVTDLPEDVKWIDITPDMMVQERSFDADCKHLSPDRCKCKKVKPTLATYLSKNYSYVIHAKIKAVQRSGCNEVTTVVDVKEIFKSSSPIPRTQVPLITNSSCQCPHILPXQDVLIMCYERRSRMMLLENCLVEKWRDQLSRRSTQWEERLQEQQRTTQDKKQIASRTSRSNPPKPKGRSPASKPASPKKNIKARSAPKKSNPKKSTS

SEQ ID NO: 100 - protein, 351 aa, Rattus norvegicus
MLRSILVALCLWLRLALGVRGAPCEAVRIPMCRHMPWNITRMPNHLHHSTQENAILAIEQYEELVDVNCSSVLRFFLCAMYAPICTLEFLHDPIKPCKSVCQRARDDCEPLMKMYNHSWPESLACDELPVYDRGVCISPEAIVTDLPEDVKWIDITPDMMVQERSFDADCKRLSPDRCKCKKVKPTLATYLSKNYSYVIHAKIKAVQRSGCNEVTTVVDVKEIFKSLSPIPRTQVPLITNSSCQCPHILPHQDVLIMCYEWRSRMMLLENCLVEKWRDQLSRRSIQWEERLQEQQRTIQDKKQIASRTSRTSRSNPPKSKGRPPAPKPASPKKNIKARSAPKKSNLKKSAS

SEQ ID NO: 101 - protein, 752 aa, Homo sapiens
MARKLSVILILTFALSVTNPLHELKAAAFPQTTEKISPNWESGINVDLAISTRQYHLQQLFYRYGENNSLSVEGFRKLLQNIGIDKIKRIHIHHDHDHHSDHEHHSDHERHSDHEHHSDHEHHSDHNHAASGKNKRKALCPDHDSDSSGKDPRNSQGKGAHRPEHASGRRNVKDSVSASEVTSTVYNTVSEGTHFLETIETPRPGKLFPKDVSSSTPPSVTSKSRVSRLAGRKTNESVSEPRKGFMYSRNTNENPQECFNASKLLTSHGMGIQVPLNATEFNYLCPAIINQIDARSCLIHTSEKKAEIPPKTYSLQIAWVGGFIAISIISFLSLLGVILVPLMNRVFFKFLLSFLVALAVGTLSGDAFLHLLPHSHASHHHSHSHEEPAMEMKRGPLFSHLSSQNIEESAYFDSTWKGLTALGGLYFMFLVEHVLTLIKQFKDKKKKNQKKPENDDDVEIKKQLSKYESQLSTNEEKVDTDDRTEGYLRADSQEPSHFDSQQPAVLEEEEVMIAHAHPQEVYNEYVPRGCKNKCHSHFHDTLGQSDDLIHHHHDYHHILHHHHHQNHHPHSHSQRYSREELKDAGVATLAWMVIMGDGLHNFSDGLAIGAAFTEGLSSGLSTSVAVFCHELPHELGDFAVLLKAGMTVKQAVLYNALSAMLAYLGMATGIFIGHYAENVSMWIFALTAGLFMYVALVDMVPEMLHNDASDHGCSRWGYFFLQNAGMLLGFGIMLLIPYLNIKSCSYKFLVKV

SEQ ID NO: 102 - protein, 755 aa, Homo sapiens; identical to SEQ ID NO: 26

SEQ ID NO: 103 - protein, 749 aa, Homo sapiens
MARKLSVILILTFALSVTNPLHELKAAAFPQTTEKISPNWESGINVDLAISTRQYHLQQLFYRYGENNSLSVEGFRKLLQNIGIDKIKRIHIHHDHDHHSDHEHHSDHERHSDHEHHSDHEHHSDHNHAASGKNKRKALCPDHDSDSSGKDPRNSQGKGAHRPEHASGRRNVKDSVSASEVTSTVYNTVSEGTHFLETIETPRPGKLFPKDVSSSTPPSVTSKSRVSRLAGRKTNESVSEPRKGFMYSRNTNENPQECFNASKLLTSHGMGIQVPLNATEFNYLCPAIINQIDARSCLIHTSEKKAEIPPKTYSLQIAWVGGFIAISIISFLSLLGVILVPLMNRVFFKFLLSFLVALAVGTLSGDAFLHLLPHSHASHHHSHSHEEPAMEMKRGPLFSHLSSQNIEESAYFDSTWKGLTALGGLYFMFLVEHVLTLIKQFKDKKKKNQKKPENDDDVEIKKQLSKYESQLSTNEEKVDTDDRTEGYLRADSQEPSHFDSQQPAVLEEEEVMIAHAHPQEVYNEYVPRGCKNKCHSHFHDTLGQSDDLIHHHHDYHHILHHHHHQNHHPHSHSQRYSREELKDAGVATLAWMVIMGDGLHNFSDGLAIGAAFTEGLSSGLSTSVAVFCHELPHELGDFAVLLKAGMTVKQAVLYNALSAMLAYLGMATGIFIGHYAENVSMWIFALTAGLFMYVALVDMVPEMLHNDASDHGCSRWGYFFLQNAGMLLGFGIMLLISIFEHKIVFRINF

SEQ ID NO: 104 - protein, 382 aa, Homo sapiens
FLHLLPHSHASHHHSHSHEEPAMEMKRGPLFSHLSSQNIEESAYFDSTWKGLTALGGLYFMFLVEHVLTLIKQFKDKKKKNQKKPENDDDVEIKKQLSKYESQLSTNEEKVDTDDRTEGYLRADSQEPSHFDSQQPAVLEEEEVMIAHAHPQEVYNEYVPRGCKNKCHSHFHDTLGQSDDLIHHHHDYHHILHHHHHQNHHPHSHSQRYSREELKDAGVATLAWMVIMGDGLHNFSDGLAIGAAFTEGLSSGLSTSVAVFCHELPHELGDFAVLLKAGMTVKQAVLYNALSAMLAYLGMATGIFIGHYAENVSMWIFALTAGLFMYVALVDMVPEMLHNDASDHGCSRWGYFFLQNAGMLLGFGIMLLISIFEHKIVFRINF

SEQ ID NO: 105 - protein, 531 aa, Homo sapiens
RVYADAPAKLLLPPPAAWDLAVRLRGAEAASERQVYSVTMKLLLLHPAFQSCLLLTLLGLWRTTPEAHASSLGAPAISAASFLQDLIHRYGEGDSLTLQQLKALLNHLDVGVGRGNVTQHVQGHRNLSTCFSSGDLFTAHNFSEQSRIGSSELQEFCPTILQQLDSRACTSENQENEENEQTEEGRPSAVEVWGYGLLCVTVISLCSLLGASVVPFMKKTFYKRLLLYFIALAIGTLYSNALFQLIPEAFGFNPLEDYYVSKSAVVFGGFYLFFFTEKILKILLKQKNEHHHGHSHYASESLPSKKDQEEGVMEKLQNGDLDHMIPQHCSSELDGKAPMVDEKVIVGSLSVQDLQASQSACYWLKGVRYSDIGTLAWMITLSDGLHNFIDGLAIGASFTVSVFQGISTSVAILCEEFPHELGDFVILLNAGMSIQQALFFNFLSACCCYLGLAFGILAGSHFSANWIFALAGGMFLYISLADMFPEMNEVCQEDERKGSILIPFIIQNLGLLTGFTIMVVLTMYSGQIQIG

SEQ ID NO: 106 - protein, 1219 aa, Homo sapiens; identical to SEQ ID NO: 28

SEQ ID NO: 107 - protein, 1229 aa, Rattus norvegicus
MLRRVAVAAVFATGRKLRCEAGRDVTAVGRIEARGLCEESAKPFPTLTMPGRNKAKSTCSCPDLQPNGQDLGESGRVARLGADESEEEGRSLSNVGDPEIIKSPSDPKQYRYIKLQNGLQALLISDLSNVEGKTGNATDEEEEEEEEEEEGEEEEEEEEDDDDDDDEDSGAEIQDDDEEGFDDEEEFDDDEHDDDDLDNEENELEELEERVEARKKTTEKQQSQNLFLLWSKLTDRLWFKSSYSKMSSTLLVETRNLYGVVGAESRSAPVEHLAGWQVEEQQGETDTVLSAAALCVGVGSFADPDDLPGLAHFLEHMVFMGSLKYPDENGFDAFLKKHGGSDNASTDCERTVFQFDVQRKYFKEALDRWAQFFIHPLMIRDAIDREVEAVDSEYQLARPSDANRKEMLFGSLARPGHPMGKFFWGNAETLKHEPKKNNIDTHARLREFWMRYYSAHYMTLVVQSKETLDTLEKWVTEIFSQIPNNGLPKPNFSHLTDPFDTPAFNKLYRVVPIRKIHALTITWALPPQQQHYRVKPLHYISWLVGHEGKGSILSYLRKKCWALALFGGNGETGFEQNSTYSVFSISITLTDEGYEHFYEVAHTVFQYLKMLQKLGPEKRVFEEIQKIEDNEFHYQEQTDPVEYVENMCENMQLYPRQDFLTGDQLLFEYKPEVIAEALNQLVPQKANLVLLSGANEGRCDLKEKWFGTQYSIEDIENSWTELWKSNFDLNSDLHLPAENKYIATDFTLKAFDCPETEYPAKIVNTPQGCLWYKKDNKFKIPKAYIRFHLISPLIQKSAANVVLFDIFVNILTHNLAEPAYEADVAQLEYKLVAGEHGLIIRVKGFNHKLPLLFQLIIDYLTEFSSTPAVFTMITEQLKKTYFNILIKPETLAKDVRLLILEYSRWSMIDKYRALMDGLSLESLLNFVKDFKSQLFVEGLVQGNVTSTESMDFLRYVVDKLNFVPLEREMPVQFQVVELPSGHHLCKVRALNKGDANSEVTVYYQSGTRSLREYTLMELLVMHMEEPCFDFLRTKQTLGYHVYPTCRNTSGILGFSVTVGTQATKYNSETVDKKIEEFLSSFEEKIENLTEDAFNTQVTALIKLKECEDTHLGEEVDRNWNEVVTQQYLFDRLAHEIEALKSFSKSDLVSWFKAHRGPGSKMLSVHVVGYGKYELEEDGAPVCEDPNSREGMQLIYLPPSPLLAESTTPITDIRAFTATLSLFPYHKIVK

SEQ ID NO: 108 - protein, 1017 aa, Homo sapiens
MLRRVTVAAVCATRRKLCEAGRELAALWGIETRGRCEDSAAARPFPILAMPGRNKAKSTCSCPDLQPNGQDLGENSRVARLGADESEEEGRRGSLSNAGDPEIVKSPSDPKQYRYIKLQNGLQALLISDLSNMEGKTGNTTDDEEEEEVEEEEEDDDEDSGAEIEDDDEEGFDDEDEFDDEHDDDLDTEDNELEELEERAEARKKTTEKQQLQSLFLLWSKLTDRLWFKSTYSKMSSTLLVETRNLYGVVGAESRSAPVQHLAGWQAEEQQGETDTVLSAAALCVGVGSFADPDDLPGLAHFLEHMVFMGSLKYPDENGFDAFLKKHGGSDNASTDCERTVFQFDVQRKYFKEALDRWAQFFIHPLMIRDAIDREVEAVDSEYQLARPSDANRKEMLFGSLARPGHPMGKFFWGNAETLKHEPRKNNIDTHARLREFWMRYYSSHYMTLVVQSKETLDTLEKWVTEIFSQIPNNGLPRPNFGHLTDPFDTPAFNKLYRVVPIRKIHALTITWALPPQQQHYRVKPLHYISWLVGHEGKGSILSFLRKKCWALALFGGNGETGFEQNSTYSVFSISITLTDEGYEHFYEVAYTVFQYLKMLQKLGPEKRIFEEIRKIEDNEFHYQEQTDPVEYVENMCENMQLYPLQDILTGDQLLFEYKPEVIGEALNQLVPQKANLVLLSGANEGKCDLKEKWFGTQYSIEDIENSWAELWNSNFELNPDLHLPAENKYIATDFTLKAFDCPETEYPVKIVNTPQGCLWYKKDNKFKIPKAYIRFHLISPLIQKSAANVVLFDIFVNILTHNLAEPAYEADVAQLEYKLVAGEHGLIIRVKGFNHKLPLLFQLIIDYLAEFNSTPAVFTMITEQLKKTYFNILIKPETLAKDVRLLILEYARWSMIDKYQALMDGLSLESLLSFVKEFKSQLFVEGLVQGNVTSTESMDFLKYVVDKLNFKPLEQEMPVQFQVVELPSGHHLCKVKALNKGDANSEVTVYYQVRYQESKRIYAYGAACDAHGRTLF

SEQ ID NO: 109 - protein, 862 aa, Homo sapiens
WAQFFIHPLMIRDAIDREVEAVDSEYQLARPSDANRKEMLFGSLARPGHPMGKFFWGNAETLKHEPRKNNIDTHARLREFWMRYYSSHYMTLVVQSKETLDTLEKWVTEIFSQIPNNGLPRPNFGHLTDPFDTPAFNKLYRVVPIRKIHALTITWALPPQQQHYRVKPLHYISWLVGHEGKGSILSFLRKKCWALALFGGNGETGFEQNSTYSVFSISITLTDEGYEHFYEVAYTVFQYLKMLQKLGPEKRIFEEIRKIEDNEFHYQEQTDPVEYVENMCENMQLYPLQDILTGDQLLFEYKPEVIGEALNQLVPQKANLVLLSGANEGKCDLKEKWFGTQYSIEDIENSWAELWNSNFELNPDLHLPAENKYIATDFTLKAFDCPETEYPVKIVNTPQGCLWYKKDNKFKIPKAYIRFHLISPLIQKSAANVVLFDIFVNILTHNLAEPAYEADVAQLEYKLVAGEHGLIIRVKGFNHKLPLLFQLIIDYLAEFNSTPAVFTMITEQLKKTYFNILIKPETLAKDVRLLILEYARWSMIDKYQALMDGLSLESLLSFVKEFKSQLFVEGLVQGNVTSTESMDFLKYVVDKLNFKPLEQEMPVQFQVVELPSGHHLCKVKALNKGDANSEVTVYYQSGTRSLREYTLMELLVMHMEEPCFDFLRTKQTLGYHVYPTCRNTSGILGFSVTVGTQATKYNSEVVDKKIEEFLSSFEEKIENLTEEAFNTQVTALIKLKECEDTHLGEEVDRNWNEVVTQQYLFDRLAHEIEALKSFSKSDLVNWFKAHRGPGSKMLSVHVVGYGKYELEEDGTPSSEDSNSSCEVMQLTYLPTSPLLADCIIPITDIRAFTTTLNLLPYHKIVK

SEQ ID NO: 110 - protein, 1077 aa, Drosophila melanogaster
MTDQVKYLDIPDKSETDKKLYKTLLLGNGLHALIVSDPSPMPHDGFTTSESSSSKSTVSTSSSIISRSESTSSTSTDSESSEESSSEEGDEKLAACALLIDYGSFAEPTKYQGLAHFLEHMIFMGSEKYPKENIFDAHIKKCGGFANANTDCEDTLFYFEVAEKHLDSSLDYFTALMKAPLMKQEAMQRERSAVDSEFQQILQDDETRRDQLLASLATKGFPHGTFAWGNMKSLKENVDDAELHKILHEIRKEHYGANRMYVCLQARLPIDELESLVVRHFSGIPHNEVKAPDLSSFNYKDAFKAEFHEQVFFVKPVENETKLELTWVLPNVRQYYRSKPDQFLSYLLGYEGRGSLCAYLRRRLWALQLIAGIDENGFDMNSMYSLFNICIYLTDEGFKNLDEVLAATFAYVKLFANCGSMKDVYEEQQRNEETGFRFHAQRPAFDNVQELVLNLKYFPPKDILTGKELYYEYNEEHLKELISHLNEMKFNLMVTSRRKYDDISAYDKTEEWFGTEYATIPMPEKWRKLWEDSVPLPELFLPESNKYVTDDFTLHWHSMGRPEVPDSPKLLIKTDTCELWFRQDDKFDLPEAHMAFYFISPMQRQNAKNDAMCSLYEEMVRFHVCEELYPAISAGLSYSLSTIEKGLLLKVCGYNEKLHLIVEAIAEGMLNVAETLDENMLSAFVKNQRKAFFNALIKPKALNRDIRLCVLERIRWLMINKYKCLSSVILEDMREFAHQFPKELYIQSLIQGNYTEESAHNVMNSLLSRLNCKQIRERGRFLEDITVKLPVGTSIIRCHALNVQDTNTVITNFYQIGPNTVRVESILDLLMMFVDEPLFDQLRTKEQLGYHVGATVRLNYGIAGYSIMVNSQETKTTADYVEGRIEVFRAKMLQILRHLPQDEYEHTRDSLIKLKLVADLALSTEMSRNWDEIINESYLFDRRRRQIEVIGHRPAGMPEPLCGEDTAKCASKSDDESESENDDDDDEDEEEEESSEEEEEEEKEKEGLKGEDEDDLFYSLENKLNIVFLPAKFNNAFIITDIEKFKDDQYVYPQQKTQPKEEDELISAHIADAIRQV

SEQ ID NO: 111 - protein, 638 aa, Homo sapiens
MILFKQATYFISLFATVSCGCLTQLYENAFFRGGDVASMYTPNAQYCQMRCTFHPRCLLFSFLPASSINDMEKRFGCFLKDSVTGTLPKVHRTGAVSGHSLKQCGHQISACHRDIYKGVDMRGVNFNVSKVSSVEECQKRCTNNIRCQFFSYATQTFHKAEYRNNCLLKYSPGGTPTAIKVLSNVESGFSLKPCALSEIGCHMNIFQHLAFSDVDVARVLTPDAFVCRTICTYHPNCLFFTFYTNVWKIESQRNVCLLKTSESGTPSSSTPQENTISGYSLLTCKRTLPEPCHSKIYPGVDFGGEELNVTFVKGVNVCQETCTKMIRCQFFTYSLLPEDCKEEKCKCFLRLSMDGSPTRIAYGTQGSSGYSLRLCNTGDNSVCTTKTSTRIVGGTNSSWGEWPWQVSLQVKLTAQRHLCGGSLIGHQWVLTAAHCFDGLPLQDVWRIYSGILNLSDITKDTPFSQIKEIIIHQNYKVSEGNHDIALIKLQAPLNYTEFQKPICLPSKGDTSTIYTNCWVTGWGFSKEKGEIQNILQKVNIPLVTNEECQKRYQDYKITQRMVCAGYKEGGKDACKGDSGGPLVCKHNGMWRLVGITSWGEGCARREQPGVYTKVAEYMDWILEKTQSSDGKAQMQSPA

SEQ ID NO: 112 - protein, 638 aa, Homo sapiens
  VARIANT (160)..(163): Where Xaa is any amino acid as defined in the specification
MILFKQATYFISLFATVSCGCLTQLYENAFFRGGDVASMYTPNAQYCQMRCTFHPRCLLFSFLPASSINDMEKRFGCFLKDSVTGTLPKVHRTGAVSGHSLKQCGHQISACHRDIYKGVDMRGVNFNVSKVSRVEECQKRCTNNIRCQVFSYAPHTFHKXXXXNNCLLKYSPGGTPTAIKVLSNVESGFSLKPCALSEIGCHMNIFQHLAFSDVDVARVLTPDAFVCRTICTYHPNCLFFTFYTNVWKIESQRNVCLLKTSESGTPSSSTPQENTISGYSLLTCKRTLPEPCHSKIYPGVDFGGEELNVTFVKGVNVCQETCTKMIRCQFFTYSLLPEDCKEEKCKCFLRLSMDGSPTRIAYGTQGSSGYSLRLCNTGDNSVCTTKTSTRIVGGTNSSWGEWPWQVSLQVKLTAQRHLCGGSLIGHQWVLTAAHCFDGLPLQDVWRIYSGILNLSDITKDTPFSQIKEIIIHQNYKVSEGNHDIALIKLQAPLNYTEFQKPICLPSKGDTSTIYTNCWVTGWGFSKEKGEIQNILQKVNIPLVTNEECQKRYQDYKITQRMVCAGYKEGGKDACKGDSGGPLVCKHNGMWRLVGITSWGEGCARREQPGVYTKVAEYMDWILETTQSSDGKAQMQSPA

SEQ ID NO: 113 - protein, 643 aa, Mus musculus
MEVIVLFRIISFRQAVYFMCLFAAVSCGCLPQLHKNTFFRGGDVSAMYTPSARHCQMMCTFHPRCLLFSFLPADSTSVTDKRFGCFLKDSVTGMLPRVLRENAISGHSLKQCGHQIRACHRDIYKGIDMRGVNFNVSKVKTVEECQERCTNSIHCLFFTYATQAFNNAEYRNNCLLKHSPGGTPTSIKVLANVESGFSLKPCADSEIGCHMDIFQHLAFSDVDVARVIAPDAFVCRTICTYHPNCLFFTFYTNAWKIESQRNVCFLKTSHSGTPSFPTPQENAISGYSLLTCKQTLPEPCHSKIYSEVDFEGEELNVTFVQGANLCQETCTKTIRCQFFTYSLHPEDCRGEKCKCSLRLSSDGSPTKITHGMRASSGYSLRLCRSGDHSACATKANTRIVGGTDSFLGEWPWQVSLQAKLRAQNHLCGGSIIGHQWVLTAAHCFDGLSLPDIWRIYGGILNISEITKETPFSQVKEIIIHQNYKILESGHDIALLKLETPLNYTDFQKPICLPSRDDTNVVYTNCWVTGWGFTEEKGEIQNILQKVNIPLVSNEECQKSYRDHKISKQMICAGYKEGGKDACKGESGGPLVCKYNGIWHLVGTTSWGEGCARREQPGVYTKVIEYMDWILEKTQDDDGQSWMK

SEQ ID NO: 114 - protein, 638 aa, Mus musculus
MILFNRVGYFVSLFATVSCGCMTQLYKNTFFRGGDLAAIYTPDAQYCQKMCTFHPRCLLFSFLAVTPPKETNKRFGCFMKESITGTLPRIHRTGAISGHSLKQCGHQISACHRDIYKGLDMRGSNFNISKTDNIEECQKLCTNNFHCQFFTYATSAFYRPEYRKKCLLKHSASGTPTSIKSADNLVSGFSLKSCALSEIGCPMDIFQHSAFADLNVSQVITPDAFVCRTICTFHPNCLFFTFYTNEWETESQRNVCFLKTSKSGRPSPPIPQENAISGYSLLTCRKTRPEPCHSKIYSGVDFEGEELNVTFVQGADVCQETCTKTIRCQFFIYSLLPQDCKEEGCKCSLRLSTDGSPTRITYGMQGSSGYSLRLCKLVDSPDCTTKINARIVGGTNASLGEWPWQVSLQVKLVSQTHLCGGSIIGRQWVLTAAHCFDGIPYPDVWRIYGGILSLSEITKETPSSRIKELIIHQEYKVSEGNYDIALIKLQTPLNYTEFQKPICLPSKADTNTIYTNCWVTGWGYTKEQGETQNILQKATIPLVPNEECQKKYRDYVINKQMICAGYKEGGTDACKGDSGGPLVCKHSGRWQLVGITSWGEGCGRKDQPGVYTKVSEYMDWILEKTQSSDVRALETSSA

SEQ ID NO: 115 - protein, 638 aa, Rattus norvegicus
MILFKQVGYFVSLFATVSCGCLSQLYANTFFRGGDLAAIYTPDAQHCQKMCTFHPRCLLFSFLAVSPTKETDKRFGCFMKESITGTLPRIHRTGAISGHSLKQCGHQLSACHQDIYEGLDMRGSNFNISKTDSIEECQKLCTNNIHCQFFTYATKAFHRPEYRKSCLLKRSSSGTPTSIKPVDNLVSGFSLKSCALSEIGCPMDIFQHFAFADLNVSQVVTPDAFVCRTVCTFHPNCLFFTFYTNEWETESQRNVCFLKTSKSGRPSPPIIQENAVSGYSLFTCRKARPEPCHFKIYSGVAFEGEELNATFVQGADACQETCTKTIRCQFFTYSLLPQDCKAEGCKCSLRLSTDGSPTRITYEAQGSSGYSLRLCKVVESSDCTTKINARIVGGTNSSLGEWPWQVSLQVKLVSQNHMCGGSIIGRQWILTAAHCFDGIPYPDVWRIYGGILNLSEITNKTPFSSIKELIIHQKYKMSEGSYDIALIKLQTPLNYTEFQKPICLPSKADTNTIYTNCWVTGWGYTKERGETQNILQKATIPLVPNEECQKKYRDYVITKQMICAGYKEGGIDACKGDSGGPLVCKHSGRWQLVGITSWGEGCARKEQPGVYTKVAEYIDWILEKIQSSKERALETSPA

SEQ ID NO: 116 - protein, 856 aa, Drosophila melanogaster
MANRTVKEAKNVHGTNPQYLIEKIIRSRIYDSKYWKEQCFALTAELLVDKAMELRFVGGVYGGNIKPTQFLCLTLKMLQIQPEKDIVVEFIKNEEFKYVRALGAFYLRLTGAALDCYKYLEPLYIDNRKLRRQNRAGQFEIVYMDEYIDELLRNDRVCDIILPRIQKRSILEENNEIEPKVSVLDEDLDDELPSDEEKADETNRPKENSTAVRRPRRVRSKSRSRSRERERRSGQGNSARSRDYYDELEDYDRQRNRVRNRDTHNEDYDRRQNNGRHDRERERQDRDSIRERERDGDRDRRDRERERERDRGRHDQRERDSRGEHWCKPDASTSSVLDSEQVGTERNGSMPRSDTEALVADVETGEDSAPRILDASSAASSEQVDPPPVPPPHDYSSYRWFILEPAVFLIFFARNLIGAVYQNQILYQTCITIEKFNATQCEPLLGIDRGSDADKEVEVIVQTYSANIMMTTSLLESIIPAFASLFLGPWSDKFGRRPILLTTFTGYLTGALILIVITYITRSTNISPWWFLLSSVPSVVSGGTCALITGIYCYISDVAKERKKALRMVLNEASLCAGIMVGNVASGYIYAATNALVLFSIAGSLMMFALMYVLLFVPESLNPGDIHTGSRVREFFRFDLVTDLIRTCFKRRPNFDRTIIWLTMIALTIAIFDMEGESTVNYMFVQDKFNWTIKDFSLFNASRIVIQIVGSIVGMLVLRRVLKMSIVTMAMLSLACCVLESTVRATAVYWQELYLGMTLGMMRGVMGPMCRAILSHVAPATEVGKIFALTTSMESVSPLGAAPLYTTVYKATLENYPGAFNFISAALYFVCYILIAVIFGIQKSMGSSSVYQAIGS

SEQ ID NO: 117 - protein, 140 aa, Homo sapiens [sequence omitted]

SEQ ID NO: 118 - protein, 236 aa, Homo sapiens
MLQIQPEKDIIVEFIKNGDFKYVRMLGALYMRLTGTAIDCYKYLEPLYNDYRKIKSQNRNGEFELMHVDEFIDELLHSERVCDIILPRLQKRYVLEEAEQLEPRVSALEEDMDDVESSEEEEEEDEKLERVPSPDHRRRSYRDLDKPRRSPTLRYRRSRSRSPRRRSRSPKRRSPSPRRERHRSKSPRRHRSRSRDRRHRSRSKSPGHHRSHRHRSHSKSPERSKKSHKKSRRGNE

SEQ ID NO: 119 - protein, 320 aa, Caenorhabditis elegans
MANRTEKAAKTVKGTNPQFLVEKIIRQRIYDSMYWKEHCFALTAELVVDKGMDLRYIGGIYAGNIKPTPFLCLALKMLQIQPDKDIVLEFIQQEEFKYIRALGAMYLRLTFDSTEIYKYLEPLYNDFRKLRYMNKMGRFEAIYMDDFIDNLLREDRYCDIQLPRLQKRWALEEVDMLPSYKSLLDGDLVAMSDSDSEEEEVTKKEKPRLTSRRRSRSRDRERDVGDRREVREREKLKERRERGDDEPGPSSSGSGRRDDRDDRRRDRDRSRDRDRRDRRDDDRRDKKKESRRGGADNDEEREIAEANALRAKLGLAPLER

SEQ ID NO: 120 - protein, 363 aa, Arabidopsis thaliana
MANRTDPLAKNIRGTNPQNLVEKIVRTKIYQHTFWKEQCFGLTAETLVDKAMELDHLGGTFGGSRKPTPFLCLILKMLQIQPEKEIVVEFIKNDDYKYVRILGAFYLRLTGTDVDVYRYLEPLYNDYRKVRQKLSDGNLFLWFGIEFSLTHVDEVIEELLTKDYSCDIAMPRLKKRWTLEQNGLLEPRKSVLEDDFEEEEEKEENEGIADGSEDEMDQRRKSPERERERDRDRRRDSHRHRDRDYDRDYDMDRDHDRDYERERGHGRDRDRERDRDHYRERDRDRERGRDRERDRRDRARRRSRSRSRDRKRHETDDVRDREEPKKKKEKKEKMKEDGTDHPNPEIAEMNRLRASLGMKPLRD

SEQ ID NO: 121 - protein, 524 aa, Homo sapiens; identical to SEQ ID NO: 34

SEQ ID NO: 122 - protein, 523 aa, Mus musculus
MSEDKITGTLAFTVFTAVLSSFQFGYDIGVINAPQEVIISHYRHVLGVPLDDRKAAINYDVNGTDTPLTVTPAYTTPAPWDEEETEGSAHIVTMLWSLSVSSFAVGGMVASFFGGWLGDKLGRIKAMLAANSLSLTGALLMGCSKFGPAHALIIAGRSVSGLYCGLISGLVPMYIGEIAPTTLRGALGTLHQLALVTGILISQIAGLSFILGNQDHWHILLGLSAVPALLQCLLLLFCPESPRYLYIKLEEEVRAKKSLKRLRGTEDVTKDINEMKKEKEEASTEQKVSVIQLFTDANYRQPILVALMLHMAQQFSGINGIFYYSTSIFQTAGISQPVYATIGVGAINMIFTAVSVLLVEKAGRRTLFLTGMIGMFFCTIFMSVGLVLLDKFAWMSYVSMTAIFLFVSFFEIGPGPIPWFMVAEFFSQGPRPTALALAAFSNWVCNFVIALCFQYIADFLGPYVFFLFAGVVLVFTLFTFFKVPETKGKSFEEIAAEFRKKSGSAPPRKAAVQMEFLASSESV

SEQ ID NO: 123 - protein, 523 aa, Mus musculus
MSEDKITGTLAFTVFTAVLSSFQFGYDIGVINAPQEVIISHYRHVLGVPLDDRKAAINYDVNGTDTPLTVTPAYTTPAPWDEEETEGSAHIVTMLWSLSVSSFAVDGMVASFFGGWLGDKLGRIKAMLAANSLSLTGALLMGCSKFGPAHALIIAGRSVSGLYCGLISGLVPMYIGEIAPTTLRGALGTLHQLALVTGILISQIAGLSFILGNQDHWHILLGLSAVPALLQCLLLLFCPESPRYLYIKLEEEVRAKKSLKRLRGTEDVTKDINEMKKEKEEASTEQKVSVIQLFTDANYRQPILVALMLHMAQQFSGINGIFYYSTTIFQTAGISQPVYATIGVGAINMIFTAVSVLLVEKAGRRTLFLTGMIGMFFCTIFMSVGLVLLDKFAWMSYVSMTAIFLFVSFFEIGPGPIPWFMVAEFFSQGPRPTALALAAFSNWVCNFVIALCFQYIADFLGPYVFFLFAGVVLVFTLFTFFKVPETKGKSFEEIAAEFRKKSGSAPPRKAAVQMEFLASSESV

SEQ ID NO: 124 - protein, 522 aa, Rattus norvegicus
MSEDKITGTLAFTVFTAVLGSFQFGYDIGVINAPQEVIISHYRHVLGVPLDDRRATINYDINGTDTPLIVTPAHTTPDAWEEETEGSAHIVTMLWSLSVSSFAVGGMVASFFGGWLGDKLGRIKAMLAANSLSLTGALLMGCSKFGPAHALIIAGRSVSGLYCGLISGLVPMYIGEIAPTTLRGALGTLHQLALVTGILISQIAGLSFILGNQDYWHILLGLSAVPALLQCLLLLFCPESPRYLYLKLEEEVRAKKSLKRLRGTEDITKDINEMRKEKEEASTEQKVSVIQLFTDPNYRQPIVVALMLHLAQQFSGINGIFYYSTSIFQTAGISQPVYATIGVGAINMIFTAVSVLLVEKAGRRTLFLAGMIGMFFCAVFMSLGLVLLDKFTWMSYVSMTAIFLFVSFFEIGPGPIPWFMVAEFFSQGPRPTALALAAFSNWVCNFIIALCFQYIADFLGPYVFFLFAGVVLVFTLFTFFKVPETKGKSFDEIAAEFRKKSGSAPPRKATVQMEFLGSSETV

SEQ ID NO: 125 - protein, 522 aa, Rattus norvegicus
MSEDKITGTLAFTVFTAVLGSFQFGYDIGVINAPQEVIISHYRHVLGVPLDDRRATINYDINGTDTPLIVTPAHTTPDAWEEETEGSAHIVTMLWSLSVSSFAVGGMVASFFGGWLGDKLGRIKAMLAANSLSLTGALLMGCSKFGPAHALIIAGRSVSGLYCGLISGLVPMYIGEIAPTTLRGALGTLHQLALVTGILISQIAGLSFILGNQDYWHILLGLSAVPALLQCLLLLFCPESPRYLYLNLEEEVRAKKSLKRLRGTEDITKDINEMRKEKEEASTEQKVSVIQLFTDPNYRQPIVVALMLHLAQQFSGINGIFYYSTSIFQTAGISQPVYATIGVGAINMIFTAVSVLLVEKAGRRTLFLAGMIGMFFCAVFMSLGLVLLDKFTWMSYVSMTAIFLFVSFFEIGPGPIPWFMVAEFFSQGPRPTALALAAFSNWVCNFIIALCFQYIADFLGPYVFFLFAGVVLVFTLFTFFKVPETKGKSFDEIAAEFRKKSGSAPPRKATVQMEFLGSSETV

SEQ ID NO: 126 - protein, 592 aa, Mus musculus
MAVPPLLRGALLLWQLLATGGAALEIGRFDPERGRGPAPCQAMEIPMCRGIGYNLTRMPNLLGHTSQGEAAAHCAEFSPLVQYGCHSHLRFFFCSLYAPMCTDQVSTPIPACRPMCEQARLRCAPIMEQFNFGWPDSLDCARLPTRNDPHALCMEAPENATAGPTEPHKGLGMLPVAPRPARPPGDSAPGPGSGGTCDNPEKFQYVEKSRSCAPRCGPGVEVFWSRRDKDFALVWMAVWSALCFFSTAFTVFTFLLEPHRFQYPERPIIFLSMCYNVYSLAFLIRAVAGAQSVACDQEAGALYVIQEGLENTGCTLVFLLLYYFGMASSLWWVVLTLTWFLAAGKKWGHEAIEAHGSYFHMAAWGLPALKTIVVLTLRKVAGDELTGLCYVASMDPAALTGFVLVPLSCYLVLGTSFLLTGFVALFHIRKIMKTGGTNTEKLEKLMVKIGVFSILYTVPATCVIVCYVYERLNMDFWRLRATEQPCTAATVPGGRRDCSLPGGSVPTVAVFMLKIFMSLVVGITSGVWVWSSKTFQTWQSLCYRKMAAGRARAKACRTPGGYGRGTHCHYKAPTVVLHMTKTDPSLENPTHP

SEQ ID NO: 127 - protein, 592 aa, Mus musculus
MAVPPLLRGALLLWQLLATGGAALEIGRFDPERGRGPAPCQAMEIPMCRGIGYNLTRMPNLLGHTSQGEAAAQLAEFSPLVQYGCHSHLRFFLCSLYAPMCTDQVSTPIPACRPMCEQARLRCAPIMEQFNFGWPDSLDCARLPTRNDPHALCMEAPENATAGPTEPHKGLGMLPVAPRPARPPGDSAPGPGSGGTCDNPEKFQYVEKSRSCAPRCGPGVEVFWSRRDKDFALVWMAVWSALCFFSTAFTVFTFLLEPHRFQYPERPIIFLSMCYNVYSLAFLIRAVAGAQSVACDQEAGALYVIQEGLENTGCTLVFLLLYYFGMASSLWWVVLTLTWFLAAGKKWGHEAIEAHGSYFHMAAWGLPALKTIVVLTLRKVAGDELTGLCYVASMDPAALTGFVLVPLSCYLVLGTSFLLTGFVALFHIRKIMKTGGTNTEKLEKLMVKIGVFSILYTVPATCVIVCYVYERLNMDFWRLRATEQPCTAATVPGGRRDCSLPGGSVPTVAVFMLKIFMSLVVGITSGVWVWSSKTFQTWQSLCYRKMAAGRARAKACRTPGGYGRGTHCHYKAPTVVLHMTKTDPSLENPTHL

SEQ ID NO: 128 - protein, 591 aa, Homo sapiens; identical to SEQ ID NO: 36

SEQ ID NO: 129 - protein, 549 aa, Mus musculus
EIPMCRGIGYNLTRMPNLLGHTPQGEAAAQLAEFSPLVQYGCHSHLRFFLCSLYAPMCTDQVSTPIPACRPMCEQARLRCAPIMEQFNFGWPDSLDCARLPTRNDPHALCMEAPENATAGPTEPHKGLGMLPVAPRPARPPGDSAPGPGSGGTCDNPEKFQYVEKSRSCAPRCGPGVEVFWSRRDKDFALVWMAVWSALCFFSTAFTVFTFLLEPHRFQYPERPIIFLSMCYNVYSLAFLIRAVAGAQSVACDQEAGALYVIQEDLENTGCTLVFLLLYYFGMASSLWWVVLTLTWFLAAGKKWGHEAIEAHGSYFHMAAWGLPALKTIVVLTLRKVAGDELTGLCYVASMDPAALTGFVLVPLSCYLVLGTSFLLTGFVALFHIRKIMKTGGTNTEKLEKLMVKIGVFSILYTVPATCVIVCYVYERLNMDFWRLRATEQPCTAATVPGGRRDCSLPGGSVPTVAVFMLKIFMSLVVGITSGVWVWSSKTFQTWQSLCYRKMAAGRARAKACRTPGGYGRGTHCHYKAPTVVLHMTKTDPSLENPTHL

SEQ ID NO: 130 - protein, 577 aa, Danio rerio
MGSSPQIVISLWCHLVIAAYSLEIGSYDLERGRPAKCEPIVIPMCQGIGYNLTRMPNFMDHDNQREAAIKLNEFAPLVEYGCDVHLRFFLCSLYAPMCTDQVSTSIPACRPMCEQARQECSPIMEKFNYAWPESLNCSKLPTRNDPNALCMEAPENDTKTETKKGEGMLPVPPRPRQPGAGNARSGGTMGVCENPEKFQYVEKSETCAPRCSSAVDVFWSRQDKDFAFIWMAVWSTLCFVSTAFTVLTFLLDPHRFQYPERPIIFLSMCYNVYSVAFIIRSVAGAENIACDRENGELYIIQEGLESTGCTIVFLILYYFGMASSIWWVILTLTWFLAAGKKWGHEAIESHSSYFHMAAWGIPALKTIVILTMRKVAGDELTGLCYVGSMDVGALTGFVLVPLSCYLVIGTSFILTGFVALFHIRKVMKTEGTNTEKLEKLMVKIGIYSILYTVPATCVIICYFYERLNMDYWKFRGLQSKCTTFPGRRNEDCSLDSSVPTVAVFILKIFMSLVVGITSGVWVWSSKTLQTWQGLCSRKLTDRTCRKHCSTSHCHYKAPAVILHMSKTDPYSDCPTHV

SEQ ID NO: 131 - protein, 856 aa, Homo sapiens
MALVLGSLLLLGLCGNSFSGGQPSSTDAPKAWNYELPATNYETQDSHKAGPIGILFELVHIFLYVVQPRDFPEDTLRKFLQKAYESKIDYDKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDVETIPMKNMENGNNGYHKDHVYGIHNPVMTSPSQH

SEQ ID NO: 132 - protein, 865 aa, Homo sapiens
MALVLGSLLLLGLCGNSFSGGQPSSTDAPKAWNYELPATNYETQDSHKAGPIGILFELVHIFLYVVQPRDFPEDTLRKFLQKAYESKIDYDKPETVILGLKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDVETIPMKNMENGNNGYHKDHVYGIHNPVMTSPSQH

SEQ ID NO: 133 - protein, 857 aa, Rattus norvegicus
MALVFSVLLLLGLCGKMASGGQPAFDNTPGALNYELPTTEYETQDTFNAGIIDPLYQMVHIFLNVVQPNDFPQDLVKKLIQKRFDISVDTKEVAIYEIGVLICVILGLLFIFLMPLVGFFFCMCRCCNKCGGEMHQRQKQNESCRRKCLAISLLLICLLMSLGIAFGFVANQQTRTRIQRTQKLAESNYRDLRALLTEAPKQIDYILGQYNTTKNKAFSDLDSIDSVLGGRIKGQLKPKVTPVLEEIKAMATAIRQTKDALQNMSSSLKSLRDASTQLSTNLTSVRNSIENSLNSNDCASDPASKICDSLRPQLSNLGSNHNGSQLPSVDRELNTVNDVDRTDLESLVKRGYMSIDEIPNMIQNQTGDVIKDVKKTLDSVSSKVKNMSQSIPVEEVLLQFSHYLNDSNRYIHESLPRVEEYDSYWWLGGLIVCFLLTLIVTFFYLGLLCGVFGYDKRATPTRRGCVSNTGGIFLMAGVGFSFLFCWILMILVVLTFVVGANVEKLLCEPYENKKLLQVLDTPYLLNDQWQFYLSGILLKNPDINMTFEQVYRDCKRGRGVYATFQLENVFNITENFNIERLSEDIVKELEKLNVNIDSIELLDKTGRKSLEDFAQSGIDRINYSMYLQEAEKPPTKVDLLTFASFLETEANQLPDGNLKQAFLMDAQNIRAIHQQHVPPVQQSLNSLKQSVWALKQTSSKLPEEVKKVLASLDSAQHFLTSNLSSIVIGETKKFGRTIIGYFEHYLQWVLYAITEKMTSCKPMITAMDSAVNGILCSYVADPLNLFWFGIGKATMLLLPAVIIAIKLAKYYRRMDSEDVYDDVETVPMKNLENGSNGYHKDHLYGVHNPVMTSPSRY

SEQ ID NO: 134 - protein, 867 aa, Mus musculus
MALVFSALLLLGLCGKISSEGQPAFHNTPGAMNYELPTTKYETQDTFNAGIVGPLYKMVHIFLSVVQPNDFPLDLIKKLIQNKKFDISVDSKEPEIIVLALKIALYEIGVLICAILGLLFIILMPLVGCFFCMCRCCNKCGGEMHQRQKQNAPCRRKCLGLSLLVICLLMSLGIIYGFVANQQTRTRIKGTQKLAKSNFRDFQTLLTETPKQIDYVVEQYTNTKNKAFSDLDGIGSVLGGRIKDQLKPKVTPVLEEIKAMATAIKQTKDALQNMSSSLKSLQDAATQLNTNLSSVRNSIENSLSSSDCTSDPASKICDSIRPSLSSLGSSLNSSQLPSVDRELNTVTEVDKTDLESLVKRGYTTIDEIPNTIQNQTVDVIKDVKNTLDSISSNIKDMSQSIPIEDMLLQVSHYLNNSNRYLNQELPKLEEYDSYWWLGGLIVCFLLTLIVTFFFLGLLCGVFGYDKHATPTRRGCVSNTGGIFLMAGVGFGFLFCWILMILVVLTFVVGANVEKLLCEPYENKKLLQVLDTPYLLKEQWQFYLSGMLFNNPDINMTFEQVYRDCKRGRGIYAAFQLENVVNVSDHFNIDQISENINTELENLNVNIDSIELLDNTGRKSLEDFAHSGIDTIDYSTYLKETEKSPTEVNLLTFASTLEAKANQLPEGKPKQAFLLDVQNIRAIHQHLLPPVQQSLNTLRQSVWTLQQTSNKLPEKVKKILASLDSVQHFLTNNVSLIVIGETKKFGKTILGYFEHYLHWVFYAITEKMTSCKPMATAMDSAVNGILCGYVADPLNLFWFGIGKATVLLLPAVIIAIKLAKYYRRMDSEDVYDDVETVPMKNLEIGSNGYHKDHLYGVHNPVMTSPSRY

SEQ ID NO: 135 - protein, 858 aa, Mus musculus
MALVFSALLLLGLCGKISSEGQPAFHNTPGAMNYELPTTKYETQDTFNAGIVGPLYKMVHIFLNVVQPNDFPLDLIKKLIQNKNFDISVDSKEIALYEIGVLICAILGLLFIILMPLVGCFFCMCRCCNKCGGEMHQRQKQNAPCRRKCLGLSLLVICLLMSLGIIYGFVANQQTRTRIKGTQKLAKSNFRDFQTLLTETPKQIDYVVEQYTNTKNKAFSDLDGIGSVLGGRIKDQLKPKVTPVLEEIKAMATAIKQTKDALQNMSSSLKSLQDAATQLNTNLSSVRNSIENSLSSSDCTSDPASKICDSIRPSLSSLGSSLNSSQLPSVDRELNTVTEVDKTDLESLVKRGYTTIDEIPNTIQNQTVDVIKDVKNTLDSISSNIKDMSQSIPIEDMLLQVSHYLNNSNRYLNQELPKLEEYDSYWWLGGLIVCFLLTLIVTFFFLGLLCGVFGYDKHATPTRRGCVSNTGGIFLMAGVGFGFLFCWILMILVVLTFVVGANVEKLLCEPYENKKLLQVLDTPYLLKEQWQFYLSGMLFNNPDINMTFEQVYRDCKRGRGIYAAFQLENVVNVSDHFNIDQISENINTELENLNVNIDSIELLDNTGRKSLEDFAHSGIDTIDYSTYLKETEKSPTEVNLLTFASTLEAKANQLPEGKLKQAFLLDVQNIRAIHQHLLPPVQQSLNTLRQSVWTLQQTSNKLPEKVKKILASLDSVQHFLTNNVSLIVIGETKKFGKTILGYFEHYLHWVFYAITEKMTSCKPMATAMDSAVNGILCGYVADPLNLFWFGIGKATVLLLPAVIIAIKLAKYYRRMDSEDVYDDVETVPMKNLEIDSNGYHKDHLYGVHNPVMTSPSRY

SEQ ID NO: 136 - protein, 417 aa, Homo sapiens; identical to SEQ ID NO: 40

SEQ ID NO: 137 - protein, 416 aa, Rattus norvegicus
MAKEGGRTAPCCSRPKVAALTVGTLLFLTGIGAASWAIVTILLRSDQEPLYQVQLSPGDSRLLVLDKTEGTWRLLCSSRSNARVAGLGCEEMGFLRALAHSELDVRTAGANGTSGFFCVDEGGLPLAQRLLDVISVCDCPRGRFLTATCQDCGRRKLPVDRIVGGQDSSLGRWPWQVSLRYDGTHLCGGSLLSGDWVLTAAHCFPERNRVLSRWRVFAGAVARTSPHAVQLGVQAVIYHGGYLPFRDPTIDENSNDIALVHLSSSLPLTEYIQPVCLPAAGQALVDGKVCTVTGWGNTQFYGQQAVVLQEARVPIISNEVCNSPDFYGNQIKPKMFCAGYPEGGIDACQGDSGGHFVCEDRISGTSRWRLCGIVSWGTGCALARKPGVYTKVIDFREWIFQAIKTHSEATGMVTQP

SEQ ID NO: 138 - protein, 416 aa, Mus musculus
MAKEGGRTAACCSRPKVAALIVGTLLFLTGIGAASWAIVTILLQSDQEPLYQVQLSPGDSRLAVLDKTEGTWRLLCSSRSNARVAGLGCEEMGFLRALAHSELDVRTAGANGTSGFFCVDEGGLPLAQRLLDVISVCDCPRGRFLTATCQDCGRRKLPVDRIVGGQDSSLGRWPWQVSLRYDGTHLCGGSLLSGDWVLTAAHCFPERNRVLSRWRVFAGAVARTSPHAVQLGVQAVIYHGGYLPFRDPTIDENSNDIALVHLSSSLPLTEYIQPVCLPAAGQALVDGKVCTVTGWGNTQFYGQQAMVLQEARVPIISNEVCNSPDFYGNQIKPKMFCAGYPEGGIDACQGDSGGPFVCEDSISGTSRWRLCGIVSWGTGCALARKPGVYTKVTDFREWIFKAIKTHSEASGMVTQP

SEQ ID NO: 139 - protein, 304 aa, Homo sapiens
TSGFFCVDEGRLPHTQRLLEVISVCDCPRGRFLAAICQDCGRRKLPVDRIVGGRDTSLGRWPWQVSLRYDGAHLCGGSLLSGDWVLTAAHCFPERNRVLSRWRVFAGAVAQASPHGLQLGVQAVVYHGGYLPFRDPNSEENSNDIALVHLSSPLPLTEYIQPVCLPAAGQALVDGKICTVTGWGNTQYYGQQAGVLQEARVPIISNDVCNGADFYGNQIKPKMFCAGYPEGGIDACQGDSGGPFVCEDSISRTPRWRLCGIVSWGTGCALAQKPGVYTKVSDFREWIFQAIKTHSEASGMVTQL

SEQ ID NO: 140 - protein, 502 aa, Mus musculus
RPQLGRPHAAGCCCHPCLPGCPLLWGQTPCPCPGPETNPKPAPSPANPRVPPQPNRSTWESLTRVPDMAKEDEEPGAHRGGSTCSRPQPGKGGRTAACCSRPKVAALIVGTLLFLTGIGAASWAIVTILLQSDQEPLYQVQLSPGDSRLAVFDKTEGTWRLLCSSRSNARVAGLGCEEMGFLRALAHSELDVRTAGANGTSGFFCVDEGGLPLAQRLLDVISVCDCPRGRFLTATCQDCGRRSCRWTALWGARTAVWEGGRGRSACVMMGTTSVGGPAVSGLGADCCTLLSRAGDGPVSVASICWCCSPDLTPCCATGVQAVIYHGGYLLFRDPTIDENSNDIALVNLSSSLPLTEYIQPVCLPAAGQALVDGKVCTVTGWGNTQFYGQQAMVLQEARVPIISNEVCNSPDFYGNQIKPKMFCAGYPEGGIDACQGDSGGPFVCEDSISGTSRWRLCGIVSWGTGCALARKPGVYTKVTDFREWIFKAIKTHSEASGMVTQP

SEQ ID NO: 141 - DNA, 22 bp, Artificial Sequence
  Description of Artificial Sequence:oligonucleotide primer
tgcaaaatgaacaaccagacta

SEQ ID NO: 142 - DNA, 23 bp, Artificial Sequence
  Description of Artificial Sequence:oligonucleotide primer
atccccgccgtggagatcttcat

SEQ ID NO: 143 - DNA, 22 bp, Artificial Sequence
  Description of Artificial Sequence:oligonucleotide primer
ccagcagcataaagatcttcac

SEQ ID NO: 144 - DNA, 22 bp, Artificial Sequence
  Description of Artificial Sequence:oligonucleotide primer
cttgaagttctcacacctttgc

SEQ ID NO: 145 - DNA, 26 bp, Artificial Sequence
  Description of Artificial Sequence:oligonucleotide primer
tcataacagttactgcatcaacggtg

SEQ ID NO: 146 - DNA, 19 bp, Artificial Sequence
  Description of Artificial Sequence:oligonucleotide primer
tcatggtggaatgcacaag

SEQ ID NO: 147 - DNA, 27 bp, Artificial Sequence
  Description of Artificial Sequence:oligonucleotide primer
gtctatcttttattcaacgcaatgaca

SEQ ID NO: 148 - DNA, 23 bp, Artificial Sequence
  Description of Artificial Sequence:oligonucleotide primer
agtcacggctgcctcttcggtca

SEQ ID NO: 149 - DNA, 20 bp, Artificial Sequence
  Description of Artificial Sequence:oligonucleotide primer
gggctgtgattggaggtgtt

SEQ ID NO: 150 - DNA, 27 bp, Artificial Sequence
  Description of Artificial Sequence:oligonucleotide primer
gtctatcttttattcaacgcaatgaca

SEQ ID NO: 151 - DNA, 23 bp, Artificial Sequence
  Description of Artificial Sequence:oligonucleotide primer
cacggctgcctcttcggtcagtg

SEQ ID NO: 152 - DNA, 21 bp, Artificial Sequence
  Description of Artificial Sequence:oligonucleotide primer
gggctgtgattggaggtgtta

SEQ ID NO: 153 - DNA, 22 bp, Artificial Sequence
  Description of Artificial Sequence:oligonucleotide primer
gtgtctgtgagaggcagctatc

SEQ ID NO: 154 - DNA, 29 bp, Artificial Sequence
  Description of Artificial Sequence:oligonucleotide primer
tgcactctaaactgcaaacagaaatcagg

SEQ ID NO: 155 - DNA, 22 bp, Artificial Sequence
  Description of Artificial Sequence:oligonucleotide primer
ccccaaaagctacattttgata

SEQ ID NO: 156 - DNA, 20 bp, Artificial Sequence
  Description of Artificial Sequence:oligonucleotide primer
aggatccaggaaacgaagtg

SEQ ID NO: 157 - DNA, 27 bp, Artificial Sequence
  Description of Artificial Sequence:oligonucleotide primer
tctacgcgctatataagcaggccactg

SEQ ID NO: 158 - DNA, 20 bp, Artificial Sequence
  Description of Artificial Sequence:oligonucleotide primer
gggcatgttacaaggtcctt

SEQ ID NO: 159 - DNA, 20 bp, Artificial Sequence
  Description of Artificial Sequence:oligonucleotide primer
gcagctggacgtcctctatc

SEQ ID NO: 160 - DNA, 26 bp, Artificial Sequence
  Description of Artificial Sequence:oligonucleotide primer
ccagaacatgaacgggtccgaatact

SEQ ID NO: 161 - DNA, 20 bp, Artificial Sequence
  Description of Artificial Sequence:oligonucleotide primer
ccaggaaggactggatcttc

SEQ ID NO: 162 - DNA, 19 bp, Artificial Sequence
  Description of Artificial Sequence:oligonucleotide primer
gccaggcactgttcatctc

SEQ ID NO: 163 - DNA, 25 bp, Artificial Sequence
  Description of Artificial Sequence:oligonucleotide primer
ctcccggcaagctttctgctgaaag

SEQ ID NO: 164 - DNA, 22 bp, Artificial Sequence
  Description of Artificial Sequence:oligonucleotide primer
gacatcaggctccagatatgaa

SEQ ID NO: 165 - DNA, 22 bp, Artificial Sequence
  Description of Artificial Sequence:oligonucleotide primer
gagctcagaccgtgtctaggtt

SEQ ID NO: 166 - DNA, 23 bp, Artificial Sequence
  Description of Artificial Sequence:oligonucleotide primer
cctggggtctcctgctcagctca

SEQ ID NO: 167 - DNA, 21 bp, Artificial Sequence
  Description of Artificial Sequence:oligonucleotide primer
gtcctctccagaaggctcttc

SEQ ID NO: 168 - DNA, 22 bp, Artificial Sequence
  Description of Artificial Sequence:oligonucleotide primer
cccacaagagaggtatgtcact

SEQ ID NO: 169 - DNA, 26 bp, Artificial Sequence
  Description of Artificial Sequence:oligonucleotide primer
ttacttcccaggacatccaccctgag

SEQ ID NO: 170 - DNA, 22 bp, Artificial Sequence
  Description of Artificial Sequence:oligonucleotide primer
aaaatttggcactcacatgaag

SEQ ID NO: 171 - DNA, 22 bp, Artificial Sequence
  Description of Artificial Sequence:oligonucleotide primer
ttactgggtaggattcgctttt

SEQ ID NO: 172 - DNA, 25 bp, Artificial Sequence
  Description of Artificial Sequence:oligonucleotide primer
aaatcctccagggacacagcccatt

SEQ ID NO: 173 - DNA, 22 bp, Artificial Sequence
  Description of Artificial Sequence:oligonucleotide primer
gggagtacctgaacacctcact

SEQ ID NO: 174 - DNA, 22 bp, Artificial Sequence
  Description of Artificial Sequence:oligonucleotide primer
tcctgaacaggtacctgagcta

SEQ ID NO: 175 - DNA, 26 bp, Artificial Sequence
  Description of Artificial Sequence:oligonucleotide primer
aagcaggacgccacctctaccatcat

SEQ ID NO: 176 - DNA, 21 bp, Artificial Sequence
  Description of Artificial Sequence:oligonucleotide primer
caatgacgttgttggtaatgc

SEQ ID NO: 177 - DNA, 22 bp, Artificial Sequence
  Description of Artificial Sequence:oligonucleotide primer
tcctgaacaggtacctgagcta

SEQ ID NO: 178 - DNA, 26 bp, Artificial Sequence
  Description of Artificial Sequence:oligonucleotide primer
aagcaggacgccacctctaccatcat

SEQ ID NO: 179 - DNA, 21 bp, Artificial Sequence
  Description of Artificial Sequence:oligonucleotide primer
caatgacgttgttggtaatgc

SEQ ID NO: 180 - DNA, 22 bp, Artificial Sequence
  Description of Artificial Sequence:oligonucleotide primer
gaccagggtcatatttgcacta

SEQ ID NO: 181 - DNA, 26 bp, Artificial Sequence
  Description of Artificial Sequence:oligonucleotide primer
cctcctgaggtaacagcaagtcccat

SEQ ID NO: 182 - DNA, 21 bp, Artificial Sequence
  Description of Artificial Sequence:oligonucleotide primer
cgggaatactttccccttcta

SEQ ID NO: 183 - DNA, 21 bp, Artificial Sequence
  Description of Artificial Sequence:oligonucleotide primer
gtactcatttcgcctctggtt

SEQ ID NO: 184 - DNA, 26 bp, Artificial Sequence
  Description of Artificial Sequence:oligonucleotide primer
tgcaacaactttcaaggtccttgctg

SEQ ID NO: 185 - DNA, 21 bp, Artificial Sequence
  Description of Artificial Sequence:oligonucleotide primer
agcacaaggttgagcactttc

SEQ ID NO: 186 - DNA, 22 bp, Artificial Sequence
  Description of Artificial Sequence:oligonucleotide primer
cataatggaaacaggacctgaa

SEQ ID NO: 187 - DNA, 25 bp, Artificial Sequence
  Description of Artificial Sequence:oligonucleotide primer
ccttccagcatgccagaggaaagtt

SEQ ID NO: 188 - DNA, 20 bp, Artificial Sequence
  Description of Artificial Sequence:oligonucleotide primer
aggtcctggtagggaatgct

SEQ ID NO: 189 - DNA, 20 bp, Artificial Sequence
  Description of Artificial Sequence:oligonucleotide primer
cccattcagcttcacagaga

SEQ ID NO: 190 - DNA, 27 bp, Artificial Sequence
  Description of Artificial Sequence:oligonucleotide primer
cagatcctggcattctctcagaagctg

SEQ ID NO: 191 - DNA, 22 bp, Artificial Sequence
  Description of Artificial Sequence:oligonucleotide primer
atgctcactgtctgttccttgt

SEQ ID NO: 192 - DNA, 20 bp, Artificial Sequence
  Description of Artificial Sequence:oligonucleotide primer
ggtccaacagggctatcaat

SEQ ID NO: 193 - DNA, 26 bp, Artificial Sequence
  Description of Artificial Sequence:oligonucleotide primer
ccaaaccacgactgtcgtagcaggta

SEQ ID NO: 194 - DNA, 21 bp, Artificial Sequence
  Description of Artificial Sequence:oligonucleotide primer
tggaattcaagacccttttga

SEQ ID NO: 195 - DNA, 20 bp, Artificial Sequence
  Description of Artificial Sequence:oligonucleotide primer
cacgcactgccactataagg

SEQ ID NO: 196 - DNA, 26 bp, Artificial Sequence
  Description of Artificial Sequence:oligonucleotide primer
cttgcacatgactaagacggacccct

SEQ ID NO: 197 - DNA, 21 bp, Artificial Sequence
  Description of Artificial Sequence:oligonucleotide primer
ctagaggtgtgtggggttctc

SEQ ID NO: 198 - DNA, 20 bp, Artificial Sequence
  Description of Artificial Sequence:oligonucleotide primer
cacgcactgccactataagg

SEQ ID NO: 199 - DNA, 26 bp, Artificial Sequence
  Description of Artificial Sequence:oligonucleotide primer
cttgcacatgactaagacggacccct

SEQ ID NO: 200 - DNA, 21 bp, Artificial Sequence
  Description of Artificial Sequence:oligonucleotide primer
ctagaggtgtgtggggttctc

SEQ ID NO: 201 - DNA, 22 bp, Artificial Sequence
  Description of Artificial Sequence:oligonucleotide primer
cccgaaaaggctttatgtattc

SEQ ID NO: 202 - DNA, 27 bp, Artificial Sequence
  Description of Artificial Sequence:oligonucleotide primer
cagaaacacaaatgaaaatcctcagga

SEQ ID NO: 203 - DNA, 22 bp, Artificial Sequence
  Description of Artificial Sequence:oligonucleotide primer
tgtcagtagctttgatgcattg

SEQ ID NO: 204 - DNA, 22 bp, Artificial Sequence
  Description of Artificial Sequence:oligonucleotide primer
gcttttgggttttggaattatg

SEQ ID NO: 205 - DNA, 29 bp, Artificial Sequence
  Description of Artificial Sequence:oligonucleotide primer
tccatatttgaacataaaatcgtgtttcg

SEQ ID NO: 206 - DNA, 22 bp, Artificial Sequence
  Description of Artificial Sequence:oligonucleotide primer
gtggtgatgatggagaattgaa

SEQ ID NO: 207 - DNA, 22 bp, Artificial Sequence
  Description of Artificial Sequence:oligonucleotide primer
aggacagaacacctaggtgctt

SEQ ID NO: 208 - DNA, 24 bp, Artificial Sequence
  Description of Artificial Sequence:oligonucleotide primer
ctcttcaggtccccaggaacccct

SEQ ID NO: 209 - DNA, 22 bp, Artificial Sequence
  Description of Artificial Sequence:oligonucleotide primer
cctaatgcccacctcctaatag

SEQ ID NO: 210 - DNA, 21 bp, Artificial Sequence
  Description of Artificial Sequence:oligonucleotide primer
gaccaaactttggccatttaa

SEQ ID NO: 211 - DNA, 26 bp, Artificial Sequence
  Description of Artificial Sequence:oligonucleotide primer
cggatccatttgacacaccagcattt

SEQ ID NO: 212 - DNA, 22 bp, Artificial Sequence
  Description of Artificial Sequence:oligonucleotide primer
gtgatggtcagagcatgaattt

SEQ ID NO: 213 - DNA, 21 bp, Artificial Sequence
  Description of Artificial Sequence:oligonucleotide primer
gaccaaactttggccatttaa

SEQ ID NO: 214 - DNA, 26 bp, Artificial Sequence
  Description of Artificial Sequence:oligonucleotide primer
cggatccatttgacacaccagcattt

SEQ ID NO: 215 - DNA, 22 bp, Artificial Sequence
  Description of Artificial Sequence:oligonucleotide primer
gtgatggtcagagcatgaattt

SEQ ID NO: 216 - DNA, 19 bp, Artificial Sequence
  Description of Artificial Sequence:oligonucleotide primer
tggggtagttggagctgaa

SEQ ID NO: 217 - DNA, 25 bp, Artificial Sequence
  Description of Artificial Sequence:oligonucleotide primer
caggtctgcacctgttcagcatttg

SEQ ID NO: 218 - DNA, 22 bp, Artificial Sequence
  Description of Artificial Sequence:oligonucleotide primer
tgcagacagaactgtgtcagtt

SEQ ID NO: 219 - DNA, 22 bp, Artificial Sequence
  Description of Artificial Sequence:oligonucleotide primer
ggacttctgtggaccttatgtg

SEQ ID NO: 220 - DNA, 26 bp, Artificial Sequence
  Description of Artificial Sequence:oligonucleotide primer
ttttcctctttgctggagtgctcctg

SEQ ID NO: 221 - DNA, 22 bp, Artificial Sequence
  Description of Artificial Sequence:oligonucleotide primer
ttcctttggtttctggaacttt

SEQ ID NO: 222 - DNA, 22 bp, Artificial Sequence
  Description of Artificial Sequence:oligonucleotide primer
tcagaagggaatcatgatatcg

SEQ ID NO: 223 - DNA, 27 bp, Artificial Sequence
  Description of Artificial Sequence:oligonucleotide primer
ccttgataaaactccaggctcctttga

SEQ ID NO: 224 - DNA, 21 bp, Artificial Sequence
  Description of Artificial Sequence:oligonucleotide primer
tttggaaggtaggcatattgg

SEQ ID NO: 225 - DNA, 40 bp, Artificial Sequence
  Description of Artificial Sequence:oligonucleotide primer
ctcgaggccaggtctagcaaggcttccaaacaacatttcc

SEQ ID NO: 226 - DNA, 37 bp, Artificial Sequence
  Description of Artificial Sequence:oligonucleotide primer
gcggccgcccaccatgctgaggagagtcactgttgct

SEQ ID NO: 227 - DNA, 37 bp, Artificial Sequence
  Description of Artificial Sequence:oligonucleotide primer
ctcgagttatttgactattttatggtaggggagaagg

SEQ ID NO: 228 - DNA, 27 bp, Artificial Sequence
  Description of Artificial Sequence:oligonucleotide primer
tcaatcttctcctcaaagctagaaaga

SEQ ID NO: 229 - DNA, 27 bp, Artificial Sequence
  Description of Artificial Sequence:oligonucleotide primer
cagaggcttgaagtttagtttgtcaac

SEQ ID NO: 230 - DNA, 29 bp, Artificial Sequence
  Description of Artificial Sequence:oligonucleotide primer
gtttgtggttaaatcctttcactcgaata

SEQ ID NO: 231 - DNA, 25 bp, Artificial Sequence
  Description of Artificial Sequence:oligonucleotide primer
tttcagctggaagatgaagatctgg

SEQ ID NO: 232 - DNA, 25 bp, Artificial Sequence
  Description of Artificial Sequence:oligonucleotide primer
tcctcaattttccgaatctcttcaa

SEQ ID NO: 233 - DNA, 25 bp, Artificial Sequence
  Description of Artificial Sequence:oligonucleotide primer
tgttaaatgctggtgtgtcaaatgg

SEQ ID NO: 234 - DNA, 26 bp, Artificial Sequence
  Description of Artificial Sequence:oligonucleotide primer
cttcaacttcacggtcaattgcatct

SEQ ID NO: 235 - DNA, 28 bp, Artificial Sequence
  Description of Artificial Sequence:oligonucleotide primer
tgctctctcttctaattcttccaattca

SEQ ID NO: 236 - DNA, 25 bp, Artificial Sequence
  Description of Artificial Sequence:oligonucleotide primer
caggtagacttcgccttgttccttc

SEQ ID NO: 237 - DNA, 27 bp, Artificial Sequence
  Description of Artificial Sequence:oligonucleotide primer
ctagctttgaggagaagattgagaacc

SEQ ID NO: 238 - DNA, 27 bp, Artificial Sequence
  Description of Artificial Sequence:oligonucleotide primer
ctaaacttcaagcctctggagcaggag

SEQ ID NO: 239 - DNA, 28 bp, Artificial Sequence
  Description of Artificial Sequence:oligonucleotide primer
ccacaaactacctctactgtttcagctc

SEQ ID NO: 240 - DNA, 29 bp, Artificial Sequence
  Description of Artificial Sequence:oligonucleotide primer
catcttccagctgaaaacaagtacatagc

SEQ ID NO: 241 - DNA, 27 bp, Artificial Sequence
  Description of Artificial Sequence:oligonucleotide primer
aatttttgaagagattcggaaaattga

SEQ ID NO: 242 - DNA, 27 bp, Artificial Sequence
  Description of Artificial Sequence:oligonucleotide primer
tgacacaccagcatttaacaaacttta

SEQ ID NO: 243 - DNA, 27 bp, Artificial Sequence
  Description of Artificial Sequence:oligonucleotide primer
gtgaatatcaacttgcaaggccttctg

SEQ ID NO: 244 - DNA, 27 bp, Artificial Sequence
  Description of Artificial Sequence:oligonucleotide primer
ggaagaattagaagagagagcagaagc

SEQ ID NO: 245 - DNA, 25 bp, Artificial Sequence
  Description of Artificial Sequence:oligonucleotide primer
gaaggaacaaggcgaagtctacctg

SEQ ID NO: 246 - DNA, 34 bp, Artificial Sequence
  Description of Artificial Sequence:oligonucleotide primer
ggatccggatgtctgactcaactctatgaaaacg

SEQ ID NO: 247 - DNA, 33 bp, Artificial Sequence
  Description of Artificial Sequence:oligonucleotide primer
ctcgagtgctggtgactgcatctgagcttttcc

SEQ ID NO: 248 - DNA, 26 bp, Artificial Sequence
  Description of Artificial Sequence:oligonucleotide primer
ttttctggcattcttcatttgttacc

SEQ ID NO: 249 - DNA, 25 bp, Artificial Sequence
  Description of Artificial Sequence:oligonucleotide primer
actatagatgcgccaaacatcctgc

SEQ ID NO: 250 - DNA, 27 bp, Artificial Sequence
  Description of Artificial Sequence:oligonucleotide primer
tccttacagtcttctgggagtaaagaa

SEQ ID NO: 251 - DNA, 25 bp, Artificial Sequence
  Description of Artificial Sequence:oligonucleotide primer
agaagaggcagttggggtgataggt

SEQ ID NO: 252 - DNA, 27 bp, Artificial Sequence
  Description of Artificial Sequence:oligonucleotide primer
ttcaacactgctaaccttagacacatt

SEQ ID NO: 253 - DNA, 28 bp, Artificial Sequence
  Description of Artificial Sequence:oligonucleotide primer
gaagaatgccagaaaagatatcaagatt

SEQ ID NO: 254 - DNA, 24 bp, Artificial Sequence
  Description of Artificial Sequence:oligonucleotide primer
ttggcgcatctatagtggcatttt

SEQ ID NO: 255 - DNA, 30 bp, Artificial Sequence
  Description of Artificial Sequence:oligonucleotide primer
cccagaagactgtaaggaagagaagtgtaa

SEQ ID NO: 256 - DNA, 29 bp, Artificial Sequence
  Description of Artificial Sequence:oligonucleotide primer
cccaactgcctcttctttacattctatac

SEQ ID NO: 257 - DNA, 25 bp, Artificial Sequence
  Description of Artificial Sequence:oligonucleotide primer
aaaaaggtgcaccagtaacattcgc

SEQ ID NO: 258 - DNA, 37 bp, Artificial Sequence
  Description of Artificial Sequence:oligonucleotide primer
ggatccactgtcatcactgctgtgctgggttccttcc

SEQ ID NO: 259 - DNA, 39 bp, Artificial Sequence
  Description of Artificial Sequence:oligonucleotide primer
ctcgaggaattctgcagcaatttcctcaaaagactttcc

SEQ ID NO: 260 - DNA, 26 bp, Artificial Sequence
  Description of Artificial Sequence:oligonucleotide primer
ccctgtctgtatccagctttgcagtt

SEQ ID NO: 261 - DNA, 25 bp, Artificial Sequence
  Description of Artificial Sequence:oligonucleotide primer
tatatcggtgaaattgctccaaccg

SEQ ID NO: 262 - DNA, 27 bp, Artificial Sequence
  Description of Artificial Sequence:oligonucleotide primer
tgaaaagactcagaggatatgatgatg

SEQ ID NO: 263 - DNA, 23 bp, Artificial Sequence
  Description of Artificial Sequence:oligonucleotide primer
tttatgcaaccattggagttggc

SEQ ID NO: 264 - DNA, 27 bp, Artificial Sequence
  Description of Artificial Sequence:oligonucleotide primer
atcttcctctttgtcagcttctttgaa

SEQ ID NO: 265 - DNA, 25 bp, Artificial Sequence
  Description of Artificial Sequence:oligonucleotide primer
accagagcatggtgattagttgagc

SEQ ID NO: 266 - DNA, 27 bp, Artificial Sequence
  Description of Artificial Sequence:oligonucleotide primer
atttcaccgatatacataggaaccagg

SEQ ID NO: 267 - DNA, 25 bp, Artificial Sequence
  Description of Artificial Sequence:oligonucleotide primer
agctttgttttgctttgacttcctc

SEQ ID NO: 268 - DNA, 27 bp, Artificial Sequence
  Description of Artificial Sequence:oligonucleotide primer
ataaacaggtttgctgataccagccgt

SEQ ID NO: 269 - DNA, 26 bp, Artificial Sequence
  Description of Artificial Sequence:oligonucleotide primer
tggctatcatgctcacataactcatc

SEQ ID NO: 270 - DNA, 40 bp, Artificial Sequence
  Description of Artificial Sequence:oligonucleotide primer
ggatccggagggcagccttcatccacagatgctcctaagg

SEQ ID NO: 271 - DNA, 33 bp, Artificial Sequence
  Description of Artificial Sequence:oligonucleotide primer
ctcgagatgttgtgatgggcttgtcataacagg

SEQ ID NO: 272 - DNA, 27 bp, Artificial Sequence
  Description of Artificial Sequence:oligonucleotide primer
ttttgtatgtgtcgttgctgtaacaaa

SEQ ID NO: 273 - DNA, 26 bp, Artificial Sequence
  Description of Artificial Sequence:oligonucleotide primer
attcagtgctaggaggcggaattctt

SEQ ID NO: 274 - DNA, 27 bp, Artificial Sequence
  Description of Artificial Sequence:oligonucleotide primer
tggatgcagaacttgacaacgttaata

SEQ ID NO: 275 - DNA, 28 bp, Artificial Sequence
  Description of Artificial Sequence:oligonucleotide primer
tttttactacctgggcttactgtgtggc

SEQ ID NO: 276 - DNA, 28 bp, Artificial Sequence
  Description of Artificial Sequence:oligonucleotide primer
tgaagctcacttttgaacaagtttacag

SEQ ID NO: 277 - DNA, 27 bp, Artificial Sequence
  Description of Artificial Sequence:oligonucleotide primer
catatgatctagaagcaaaagcaaaca

SEQ ID NO: 278 - DNA, 24 bp, Artificial Sequence
  Description of Artificial Sequence:oligonucleotide primer
gccaccgctctagatactgctgtt

SEQ ID NO: 279 - DNA, 27 bp, Artificial Sequence
  Description of Artificial Sequence:oligonucleotide primer
aaataccccaccagaggcatcagaata

SEQ ID NO: 280 - DNA, 27 bp, Artificial Sequence
  Description of Artificial Sequence:oligonucleotide primer
ttgatactgttcagatctgtgaacgcc

SEQ ID NO: 281 - DNA, 24 bp, Artificial Sequence
  Description of Artificial Sequence:oligonucleotide primer
aacgttgtcaagttctgcatccac

SEQ ID NO: 282 - DNA, 26 bp, Artificial Sequence
  Description of Artificial Sequence:oligonucleotide primer
ccacacagtaagcccaggtagtaaaa

SEQ ID NO: 283 - DNA, 29 bp, Artificial Sequence
  Description of Artificial Sequence:oligonucleotide primer
aatagcttcccagagagatagtattccca

SEQ ID NO: 284 - DNA, 27 bp, Artificial Sequence
  Description of Artificial Sequence:oligonucleotide primer
aactgtttgcttttgcttctagatcat

SEQ ID NO: 285 - DNA, 25 bp, Artificial Sequence
  Description of Artificial Sequence:oligonucleotide primer
cacgatgccactttctcactgatag

SEQ ID NO: 286 - DNA, 37 bp, Artificial Sequence
  Description of Artificial Sequence:oligonucleotide primer
aagcttaggagtgaccaggagccgctgtacccagtgc

SEQ ID NO: 287 - DNA, 35 bp, Artificial Sequence
  Description of Artificial Sequence:oligonucleotide primer
gtcgacgagctgggtcaccatgccgctggcttcgg

SEQ ID NO: 288 - DNA, 27 bp, Artificial Sequence
  Description of Artificial Sequence:oligonucleotide primer
agcctcccctcgtccacacagaagaag

SEQ ID NO: 289 - DNA, 21 bp, Artificial Sequence
  Description of Artificial Sequence:oligonucleotide primer
caaagaccatgagccgagcgt

SEQ ID NO: 290 - DNA, 27 bp, Artificial Sequence
  Description of Artificial Sequence:oligonucleotide primer
tctgcgccatgtcactgcctcttgtta

SEQ ID NO: 291 - DNA, 21 bp, Artificial Sequence
  Description of Artificial Sequence:oligonucleotide primer
gtgatcacggacgcagattgg

SEQ ID NO: 292 - DNA, 20 bp, Artificial Sequence
  Description of Artificial Sequence:oligonucleotide primer
ctggatttgcagggatgggg

SEQ ID NO: 293 - DNA, 21 bp, Artificial Sequence
  Description of Artificial Sequence:oligonucleotide primer
cagaggctgctggaggtcatc

SEQ ID NO: 294 - DNA, 21 bp, Artificial Sequence
  Description of Artificial Sequence:oligonucleotide primer
gacaagacggaagggacgtgg

SEQ ID NO: 295 - DNA, 19 bp, Artificial Sequence
  Description of Artificial Sequence:oligonucleotide primer
gaaggagggtggccggact

SEQ ID NO: 296 - DNA, 19 bp, Artificial Sequence
  Description of Artificial Sequence:oligonucleotide primer
ctctggccaaggcccagtc

SEQ ID NO: 297 - DNA, 19 bp, Artificial Sequence
  Description of Artificial Sequence:oligonucleotide primer
cccgctgctggtcagacac

SEQ ID NO: 298 - DNA, 35 bp, Artificial Sequence
  Description of Artificial Sequence:oligonucleotide primer
ggatcctctgcagcggctctttgtgttggagttgg

SEQ ID NO: 299 - protein, 97 aa, Artificial Sequence
  Description of Artificial Sequence:consensus sequence
NVTISVEKEGCTSCKTVNTTICAGYCYTKDPVYKDGRSLLIQCVCCYPDVTYETKVLPGCPPGVDPTKTYPVALSCHCGKCNTDNTDCTRLSLQPDS

SEQ ID NO: 300 - protein, 76 aa, Artificial Sequence
  Description of Artificial Sequence:consensus sequence
LQEQFEAAAEKVKKLKKNPSNDELLQLYSLYKQATVGDCNTEKPGMFDLKGRAKWDAWNELKGMSKEEAMKAYIAK

SEQ ID NO: 301 - protein, 393 aa, Artificial Sequence
  Description of Artificial Sequence:consensus sequence
LPTNVVPIHYDLRLTPFLPEKPTFSGSVTITLQATIAGTDEIVLHAKDLTISSVTLVGVNGSTPESVEFSLQDETQKLTITLPQSLSAGQQYTLEIDYTGKISDSMLGFYRSEYTDGGDGETKYMATTQFEPTDARRAFPCFDEPSFKATFTITITHPKGSTALSNMPVITTTKDDDGRVITTFETTPPMSTYLLAFVVGDLTYLETETKDGVPVRVYARPGAKNAGQGQYALDVTKKLLEFYEEYFGYPYPLPKLDQVAVPDFSAGAMENWGLITYREPALLYDPRSSTNSNKQRVASVIAHELAHQWFGNLVTMKWWDDLWLNEGFATYLEYLITDELGGEPTWNMEALFGLVLQLALARDALGSSHPITVEVLTPSEISDIFDAITYEKG

SEQ ID NO: 302 - protein, 45 aa, Artificial Sequence
  Description of Artificial Sequence:consensus sequence
FQCSVPPSERINCGPPGITEAECEARGCCFDSSISGVPWCFYPNT

SEQ ID NO: 303 - protein, 224 aa, Artificial Sequence
  Description of Artificial Sequence:consensus sequence
VILFDLRGFGQSSPSDLAEYRFDDLAEDLEALLDALGLDKVILVGHSMGGAIAAAYAAKYPERVKALVLVSAPHPALLSSRLFPRNLFGLLLANFRNRLLRSVEALLGRALKQFFLLGRPLVSDFLKQFELSSLIRFGEDDGGDGLLWVALGKLLQWDVSADLKRIKVPTLVIWGDDDPLVPPDASEKLSALFPNAEVVVIDDAGHLAQLEKPEEVAELILKFL

SEQ ID NO: 304 - protein, 255 aa, Artificial Sequence
  Description of Artificial Sequence:consensus sequence
WGYGVHNGPEHWPLLYPIAGGDRQSPINIQTKKARYDPSLKPLSVSYYAATAKEITNNGHSVQVEFDDSMDKSVLSGGPLPAPYRLKQFHFHWGSSNEHGSEHTVDGVKYPAELHLVHWNSTKYGSYKEAQKKPDGLAVLGVFVKVGAENPGLQKLVDALQNIKTKGKSATFTNFDPSDLLPALRDYWTYPGSLTTPPCTESVTWIVLKEPITVSSEQLEKFRSLLFSVEGEEEVPMVDNYRPTQPLKGRVVRAS

SEQ ID NO: 305 - protein, 322 aa, Artificial Sequence
  Description of Artificial Sequence:consensus sequence
PLFSRDEHRFARSWIAWWSALCFVSTLFTVLTFLIDWKRFRYPERPIFYLSACYLIVSVGYLIRFFLGREEIACRKADGGMRTVTQGSTENLSCTVLFLLVYFFGMASSVWWVILTLTWFLAAGLKWGHEAIEAKSSYFHLVAWGLPAVLTITVLALNKVDGDPITGICFVGNLNLDALRGFVLAPLCVYLVIGTLFLLAGFVSLFRIRSVIKTQGTNTSKLEKLMVRIGVFSLLYTVPALIVIACYFYEQANRDEWERSWLDCICCQYQIPCPYKDKSSDPEARPPLAVFMLKYFMSLVVGITSGVWVWSKKTLESWRRFF

SEQ ID NO: 306 - protein, 117 aa, Artificial Sequence
  Description of Artificial Sequence:consensus sequence
RCEPITLPLCKDLGYNLTSMPNLLGHTTQEEAGLELSQFYPLLNVQCSPDLRFFLCSVYAPVCTEDLPEPILPCRSLCEAAREGCEPLMEKFGFGWPEFLRCDRFPVQNELCMDPVP

SEQ ID NO: 307 - DNA, 36 bp, Artificial Sequence
  Description of Artificial Sequence:oligonucleotide primer
agatctatggaaacaggacctgaagacccttccagc

SEQ ID NO: 308 - DNA, 33 bp, Artificial Sequence
  Description of Artificial Sequence:oligonucleotide primer
ctcgaggggtggggacgcagttcctgccgtggc

SEQ ID NO: 309 - DNA, 25 bp, Artificial Sequence
  Description of Artificial Sequence:oligonucleotide primer
gtagtgtctgacttccacgttttcg

SEQ ID NO: 310 - DNA, 21 bp, Artificial Sequence
  Description of Artificial Sequence:oligonucleotide primer
gtgtgcttcggcatccaactg

SEQ ID NO: 311 - DNA, 21 bp, Artificial Sequence
  Description of Artificial Sequence:oligonucleotide primer
atcctctccccttcgctctgt

SEQ ID NO: 312 - DNA, 20 bp, Artificial Sequence
  Description of Artificial Sequence:oligonucleotide primer
aagcacaccttcagccctgc

SEQ ID NO: 313 - DNA, 39 bp, Artificial Sequence
  Description of Artificial Sequence:oligonucleotide primer
agatctcccaccatggctaaccgtacagtgaaggatgcg

SEQ ID NO: 314 - DNA, 33 bp, Artificial Sequence
  Description of Artificial Sequence:oligonucleotide primer
gtcgacctcattccctctccggctcttcttgtg

SEQ ID NO: 315 - DNA, 24 bp, Artificial Sequence
  Description of Artificial Sequence:oligonucleotide primer
ctccacatcatccatgtcctcttc

SEQ ID NO: 316 - DNA, 24 bp, Artificial Sequence
  Description of Artificial Sequence:oligonucleotide primer
cttctcgggttgaatttgaagcat

SEQ ID NO: 317 - DNA, 25 bp, Artificial Sequence
  Description of Artificial Sequence:oligonucleotide primer
gtccagtgaagaggaagaagaggag

SEQ ID NO: 318 - DNA, 32 bp, Artificial Sequence
  Description of Artificial Sequence:oligonucleotide primer
cgagaaggatatcattgtagagtttatcaaaa

SEQ ID NO: 319 - DNA, 1089 bp, Homo sapiens
tcttccacctttctccattcctctaggtgctttttctgaacctggatgtgaggcattaaaggatccgacggaaatagaattgaaggcattctaaaatggctaaccgtacagtgaaggatgcgcacagcatccatggcaccaaccctcaatatctggtggagaagatcattcgaacgcgaatctatgagtccaagtactggaaagaggagtgctttggacttacagctgaacttgtagtcgataaagccatggagttaaggtttgtgggtggcgtctatggtggcaacataaaaccaacaccctttctgtgtttaaccttgaagatgcttcaaattcaacccgagaaggatatcattgtagagtttatcaaaaatgaagatttcaagtatgtccgcatgctgggggcactttacatgaggctgacaggcactgcaattgattgctacaagtacttggaacctttgtacaatgactatcgaaaaatcaagagccagaaccgaaatggggagtttgaattgatgcatgttgatgagtttattgatgaactattgcacagtgagagagtctgtgatatcattctgccccgactacagaaacgctatgtattagaggaagctgagcaactggagcctcgagttagtgctctggaagaggacatggatgatgtggagtccagtgaagaggaagaagaggaggatgagaagttggaaagagtgccatcacctgatcaccgccggagaagctaccgagacttggacaagccccttcgctctcccacactgcgctacaggaggagtaggagccggtctcccagaaggcggagtcgatctcccaaaaggagaagcccctcccctcgccgagaaaggcatcggagcaagagtccaagacgtcaccgcagcaggtcccgagatcggcggcacagatcccgttccaagtccccaggtcatcaccgtagtcacagacacaggagccactcaaagtctcccgaaaggtctaagaagagccacaagaagagccggagagggaatgagtaatggactcagtttggttttagtccacatggcctcctgtggatataaggatatctgt

SEQ ID NO: 320 - protein, 312 aa, Homo sapiens
MANRTVKDAHSIHGTNPQYLVEKIIRTRIYESKYWKEECFGLTAELVVDKAMELRFVGGVYGGNIKPTPFLCLTLKMLQIQPEKDIIVEFIKNEDFKYVRMLGALYMRLTGTAIDCYKYLEPLYNDYRKIKSQNRNGEFELMHVDEFIDELLHSERVCDIILPRLQKRYVLEEAEQLEPRVSALEEDMDDVESSEEEEEEDEKLERVPSPDHRRRSYRDLDKPLRSPTLRYRRSRSRSPRRRSRSPKRRSPSPRRERHRSKSPRRHRSRSRDRRHRSRSKSPGHHRSHRHRSHSKSPERSKKSHKKSRRGNE

SEQ ID NO: 321 - DNA, 861 bp, Homo sapiens
agatctatggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccacccctcgag

SEQ ID NO: 322 - protein, 287 aa, Homo sapiens
RSMETGPEDPSSMPEESSPRRTPQSIPYQDLPHLVNADGQYLFCRYWKPTGTPKALIFVSHGAGEHSGRYEELARMLMGLDLLVFAHDHVGHGQSEGERMVVSDFHVFVRDVLQHVDSMQKDYPGLPVFLLGHSMGGAIAILTAAERPGHFAGMVLISPLVLANPESATTFKVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPPLE

SEQ ID NO: 323 - DNA, 954 bp, Homo sapiens
agatctcccaccatggctaaccgtacagtgaaggatgcgcacagcatccatggcaccaaccctcaatatctggtggagaagatcattcgaacgcgaatctatgagtccaagtactggaaagaggagtgctttggacttacagctgaacttgtagtcgataaagccatggagttaaggtttgtgggtggcgtctatggtggcaacataaaaccaacaccctttctgtgtttaaccttgaagatgcttcaaattcaacccgagaaggatatcattgtagagtttatcaaaaatgaagatttcaagtatgtccgcatgctgggggcactttacatgaggctgacaggcactgcaattgattgctacaagtacttggaacctttgtacaatgactatcgaaaaatcaagagccagaaccgaaatggggagtttgaattgatgcatgttgatgagtttattgatgaactattgcacagtgagagagtctgtgatatcattctgccccgactacagaaacgctatgtattagaggaagctgagcaactggagcctcgagttagtgctctggaagaggacatggatgatgtggagtccagtgaagaggaagaagaggaggatgagaagttggaaagagtgccatcacctgatcaccgccggagaagctaccgagacttggacaagccccgtcgctctcccacactgcgctacaggaggagtaggagccggtctcccagaaggcggagtcgatctcccaaaaggagaagcccctcccctcgccgagaaaggcatcggagcaagagtccaagacgtcaccgcagcaggtcccgagatcggcggcacagatcccgttccaagtccccaggtcatcaccgtagtcacagacacaggagccactcaaagtctcccgaaaggtctaagaagagccacaagaagagccggagagggaatgaggtcgac

SEQ ID NO: 324 - protein, 312 aa, Homo sapiens; identical to SEQ ID NO: 320

What is claimed is:

1. An isolated nucleic acid molecule comprising a nucleic acid sequence encoding a polypeptide comprising an amino acid sequence of SEQ ID NO: 26.

2. An isolated nucleic acid molecule comprising a nucleotide sequence that is the complement of the nucleic acid sequence of claim 1.

3. The nucleic acid molecule of claim 1, wherein the nucleic acid molecule encodes a polypeptide consisting of the amino acid sequence of SEQ ID NO:26.

4. The nucleic acid molecule of claim 1, wherein said nucleic acid molecule comprises a nucleotide sequence of SEQ ID NO: 25.

5. The nucleic acid molecule of claim 1, wherein said nucleic acid molecule, wherein the nucleic acid molecule consists of the nucleic acid sequence of SEQ ID NO: 25.

6. A vector comprising the nucleic acid molecule of claim 1.

7. The vector of claim 6, further comprising a promoter operably-linked to said nucleic acid molecule.

8. A cell comprising the vector of claim 6.

9. A method for determining the presence or amount of the nucleic acid molecule of claim 1 in a sample, the method comprising:

(a) providing the sample;
   (b) contacting the sample with a probe that binds to said nucleic acid molecule; and
   (c) determining the presence or amount of the probe bound to said nucleic acid molecule, thereby determining the presence or amount of the nucleic acid molecule in said sample.

10. The method of claim 9 wherein presence or amount of the nucleic acid molecule is used as a marker for cell or tissue type.

11. The method of claim 10 wherein the cell or tissue type is cancerous.

12. A pharmaceutical composition comprising the nucleic acid molecule of claim 1 and a pharmaceutically-acceptable carrier.

13. A kit comprising in one or more containers, the pharmaceutical composition of claim 12.

14. A method for determining the presence of or predisposition to a disease associated with altered levels of the nucleic acid molecule of claim 1 in a first mammalian subject, the method comprising:

(a) measuring the amount of the nucleic acid in a sample from the first mammalian subject; and
   (b) comparing the amount of said nucleic acid in the sample of step (a) to the amount of the nucleic acid present in a control sample from a second mammalian subject known not to have or not be predisposed to, the disease;

wherein an alteration in the level of the nucleic acid in the first subject as compared to the control sample indicates the presence of or predisposition to the disease.

15. The method of claim 14 wherein the predisposition is to a cancer.

* * * * *